(12) United States Patent
Rossi et al.

(10) Patent No.: US 8,716,465 B2
(45) Date of Patent: *May 6, 2014

(54) KIT FOR MAKING INDUCED PLURIPOTENT STEM CELLS USING MODIFIED RNAS

(75) Inventors: Derrick Rossi, Roslindale, MA (US); Luigi Warren, Cambridge, MA (US)

(73) Assignee: Children's Medical Center Corporation, Boston, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 13/590,880

(22) Filed: Aug. 21, 2012

(65) Prior Publication Data

US 2012/0322864 A1    Dec. 20, 2012

Related U.S. Application Data

(63) Continuation of application No. 13/088,009, filed on Apr. 15, 2011.

(60) Provisional application No. 61/325,003, filed on Apr. 16, 2010, provisional application No. 61/387,220, filed on Sep. 28, 2010.

(51) Int. Cl.
*C07H 21/04*    (2006.01)

(52) U.S. Cl.
USPC .......................................... 536/24.5; 435/455

(58) Field of Classification Search
USPC .................... 536/23.1, 325, 24.5; 435/455
See application file for complete search history.

(56) References Cited

U.S. PATENT DOCUMENTS

| | | | |
|---|---|---|---|
| 8,278,036 B2 * | 10/2012 | Kariko et al. ................. | 435/325 |
| 2006/0247195 A1 | 11/2006 | Ray | |
| 2009/0180996 A1 | 7/2009 | Beyhan et al. | |
| 2009/0286852 A1 * | 11/2009 | Kariko et al. ............... | 514/44 R |
| 2010/0273220 A1 * | 10/2010 | Yanik et al. ................ | 435/91.21 |
| 2010/0279404 A1 | 11/2010 | Yamanaka et al. | |
| 2011/0065103 A1 | 3/2011 | Sahin et al. | |
| 2011/0143397 A1 | 6/2011 | Kariko et al. | |
| 2011/0143436 A1 | 6/2011 | Dahl et al. | |

FOREIGN PATENT DOCUMENTS

| | | | | |
|---|---|---|---|---|
| EP | 2191840 A1 * | 6/2010 | | |
| WO | 2009/077134 | 6/2009 | | |
| WO | WO2009077134 | * 6/2009 | | |
| WO | WO 2009/158513 | * 12/2009 | ............... | C12Q 1/68 |
| WO | WO2010033906 | * 3/2010 | | |
| WO | WO2010042490 | * 4/2010 | | |
| WO | 2010/105257 | 9/2010 | | |
| WO | 2011/130624 | 10/2011 | | |

OTHER PUBLICATIONS

Moore (2002, DNA and Cell Biol., vol. 21(5/6), pp. 443-451).*
Thomson (1995, PNAS, vol. 92, pp. 7844-7848).*
NIH (Stem Cells: Scientific Progress and Future Research Directions, Department of Health and Human Services, Chapters 1 and 3, Jun. 2001).*
Takahashi (Cell, 2006, vol. 126:663-676).*
Kariko (Mol. Ther., Nov. 2008, vol. 16, No. 11, p. 1833-1840).*
Tahiliani (Science, May 2009, vol. 324, p. 930-935).*
Ito (Nature, Aug. 2010, vol. 466, p. 1129-1133).*
Kariko (Immunity, Aug. 2005, vol. 23, p. 166-175).*
Kariko (Curr. Opin. Drug Discovery & Develop., 2007, vol. 10, No. 5, p. 523-532).*
Kariko (Mol. Ther. Nov. 2008, vol. 16, No. 11, p. 1833-1840).*
Sadler (Accession No: L07335, May 8, 1993).*
Koh (Cell Stem Cell, Feb. 4, 2011, vol. 8, p. 200-213).*
Ficz (Nature, May 19, 2011, vol. 473, p. 398-402).*
Freudenberg (Nucleic Acids Res., Dec. 30, 2011, vol. 40, p. 3364-3377).*
Sequence search results, p. 1-75, 2012.*
Blelloch (Cell Stem Cell, Sep. 13, 2007, vol. 1, p. 245-247).*
Nakagawa (Nat Biotechnol, 2008, vol. 26: 101-106).*
Morgan (J. Biol. Chem., 2004, vol. 279, 52,353-52,360).*
Yu (Science, Nov. 20, 2007, vol. 318, p. 1917-1920).*
Takahashi (Cell, 2006, vol. 126, No. 4, p. 663-676).*
Rossi, open letter, dated Aug. 13, 2011.*
LaFleur (J. of Biol. Chem., 2001, vol. 276, No. 43, p. 39765-39771).*
Zhou et al., Cell Stem Cell, 4(5):381-4 (2009). "Generation of induced pluripotent stem cells using recombinant proteins."
Warren et al., Cell Stem Cell, 7:618-630 (2010). "Highly efficient reprogramming to pluripotency and directed differentiation of human cells with synthetic modified mRNA."
Angel et al., PLoS ONE, 5(7):e11756 (2010). "Innate immune suppression enables frequent transfection with RNA encoding reprogramming proteins."
Audouy and Hoekstra, Mol. Membr. Biol.,18:129-143 (2001). "Cationic lipid-mediated transfection in vitro and in vivo."
Chan E.M.et al., Nat. Biotechnol, 27(11):1033-1037 (2009). "Live cell imaging distinguishes bona fide human iPS cells from partially reprogrammed cells."
Chang et al., Stem Cells, 27(5):1042-1049 (2009). "Polycistronic lentiviral vector for 'hit and run' reprogramming of adult skin fibroblasts to induced pluripotent stem cells."
Davis et al., Cell, 51:987-1000 (1987). "Expression of a single transfected cDNA converts fibroblasts to myoblasts."

(Continued)

*Primary Examiner* — Michael C. Wilson
(74) *Attorney, Agent, or Firm* — Nixon Peabody LLP; David S. Resnick; Leena H. Karttunen Contarino

(57) ABSTRACT

Described herein are synthetic, modified RNAs for changing the phenotype of a cell, such as expressing a polypeptide or altering the developmental potential. Accordingly, provided herein are compositions, methods, and kits comprising synthetic, modified RNAs for changing the phenotype of a cell or cells. These methods, compositions, and kits comprising synthetic, modified RNAs can be used either to express a desired protein in a cell or tissue, or to change the differentiated phenotype of a cell to that of another, desired cell type.

16 Claims, 45 Drawing Sheets

(21 of 45 Drawing Sheet(s) Filed in Color)

(56) References Cited

OTHER PUBLICATIONS

Diebold et al., Science, 303:1529-1531 (2004). "Innate antiviral responses by means of TLR7-mediated recognition of single-stranded RNA."
Elango et al., Biochem. Biophys. Res. Commun., 330:958-966 (2005). "Optimized transfection of mRNA transcribed from a d(A/T)100 tail-containing vector."
Fusaki et al., Proc Jpn Acad Ser B, 85(8): p. 348-62 (2009). "Efficient induction of transgene-free human pluripotent stem cells using a vector based on Sendai virus, an RNA virus that does not integrate into the host genome."
Hanna et al., Nature, 462(7273):595-601 (2009). "Direct cell reprogramming in a stochastic process amenable to acceleration."
Holtkamp et al., Blood, 108:4009-4017 (2006). "Modification of antigen-encoding RNA increases stability, translational efficacy, and T-cell stimulatory capacity of dendritic cells."
Hornung et al., Science, 314:994-997 (2006). "5'-triphosphate RNA is the ligand for RIG-I."
Hu et al., Proc. Natl. Acad. Sci USA 107(9):4335-4340 (2010). "Neural differentiation of human induced pluripotent stem cells follows developmental principles but with variable potency."
Huangfu et al., Nature Biotechnology 26(7):795-797 (2008). "Induction of pluripotent stem cells by defined factors is greatly improved by small-molecule compounds."
Jia et al., Nat. Methods, 7:197-199 (2010). "A nonviral minicircle vector for deriving human iPS cells."
Kaji et al., Nature, 458(7239):771-5 (2009). "Virus free induction of pluripotency and subsequent excision of reprogramming factors."
Kariko and Weissman, Curr. Opin. Drug Discov. Devel., 10:523-532 (2007). "Naturally occurring nucleoside modifications suppress the immunostimulatory activity of RNA: implication for therapeutic RNA development."
Kariko et al., Immunity, 23:165-175 (2005). "Suppression of RNA recognition by toll-like receptors: the impact of nucleoside modification and the evolutionary origin of RNA."
Kariko et al., Mol. Ther., 16(11):1833-1840 (2008). "Incorporation of Pseudouridine into mRNA yields superior nonimmunogenic vector with increased translational capacity and biological stability."
Kawai and Akira, J. Biochem. 141:137-145 (2007). "Antiviral signaling through pattern recognition receptors."
Kawamura et al., Nature, 460(7259):1140-1144 (2009). "Linking the p53 tumor suppressor pathway to somatic cell reprogramming."
Kim, et al., Cell Stem Cell, 4(6):472-476 (2009). "Generation of human-induced pluripotent stem cells by direct delivery of reprogramming proteins."
Lowry et al., Proc. Natl. Acad. Sci. USA ,105(8):2883-2888 (2008). "Generation of human induced pluripotent stem cells from dermal fibroblasts."
Marson et al., Cell Stem Cell, 3(2):132-135 (2008). "Wnt signaling promotes reprogramming of somatic cells to pluripotency."
Miura et al., Nat. Biotechnol. 27(8):743-745 (2009). "Variation in the safety of induced pluripotent stem cell lines."
Nallagatla and Bevilacqua, RNA, 14:1201-1213 (2008). "Nucleoside modifications modulate activiation of the protein kinase PKR in an RNA structure-specific manner."
Nallagatla et al., RNA Biol, 5(3):140-144 (2008). "A brilliant disguise for self RNA: 5'-end and internal modifications of primary transcripts suppress elements of innate immunity."
Okita et al., Science, 322(5903):949-53 (2008). "Generation of mouse induced pluripotent stem cells without viral vectors."
Papapetrou et al., Proc. Natl. Acad. Sci USA, 106(31):12759-12764 (2009). "Stoichiometric and temporal requirements of Oct4, Sox2, Klf4, and c-Myc expression for efficient human iPSC induction and differentiation."
Park et al., Nature, 451:141-146 (2008). "Reprogramming of human somatic cells to pluripotency with defined factors."
Pichlmair et al., Science, 314:997-1001 (2006). "RIG-I-mediated antiviral responses to single-stranded RNA bearing 5'-phosphates."
Rabinovich et al., Hum. Gene Ther.,17:1027-1035 (2006). "Synthetic messenger RNA as a tool for gene therapy."
Rabinovich et al., Hum. Gen. Ther., 20:51-61 (2008). "Chimeric receptor mRNA transfection as a tool to generate antineoplastic lymphocytes."
Ryser et al., Tissue Eng Part C Methods, 14(3):179-84 (2008). "mRNA transfection of CXCR4-GFP fusion—simply generated by PCR—results in efficient migration of primary human mesenchymal stem cells."
Shi et al., Cell Stem Cell, 2:525-528 (2008). "A combined chemical and genetic approach for the generation of induced pluripotent stem cells."
Smith et al., J. Cell. Physiol., 220:21-29 (2009). "Pluripotency: toward a gold standard for human ES and iPS cells."
Stadtfeld et al., Science, 322(5903):945-9 (2008). "Induced pluripotent stem cells generated without viral integration."
Takahashi and Yamanaka, Cell,126(4):663-76 (2006). "Induction of pluripotent stem cells from mouse embryonic and adult fibroblast cultures by defined factors."
Takahashi et al., Cell, 131(5):861-72 (2007). "Induction of pluripotent stem cells from adult human fibroblasts by defined factors."
Uematsu and Akira, J Biol Chem., 282(21):15319-23 (2007). "Toll-like receptors and type I interferons."
Utikal et al., Nature, 460:1145-1148 (2009). "Immortalization eliminates a roadblock during cellular reprogramming into iPS cells."
Uzri and Gehrke, J. Virol, 83(9):4174-4184 (2009). "Nucleotide sequences and modifications that determine RIG-I/RNA binding and signaling activities."
Van Den Bosch et al., J. Immunother., 29(5):512-523 (2006). "Simultaneous activation of viral antigen-specific memory CD4+ and CD8+ T-cells using mRNA-electroporated CD40-activated autologous B-cells."
Van Tendeloo et al., Blood, 98(1):49-56 (2001). "Highly efficient gene delivery by mRNA electroporation in human hematopoietic cells: superiority to lipofection and passive pulsing of mRNA and to electroporation of plasmid cDNA for tumor antigen loading of dendritic cells."
Watanabe et al., Nat. Biotechnol., 25(6):681-686 (2007). "A ROCK inhibitor permits survival of dissociated human embryonic stem cells."
Weissman et al., J. Immunol.,165:4710-4717 (2000). "HIV gag mRNA transfection of dendritic cells (DC) delivers encoded antigen to MHC class I and II molecules, causes DC maturation, and induces a potent human in vitro primary immune response."
Woltjen et al., Nature, 458:766(2009). "piggyBac transposition reprograms fibroblasts to induced pluripotent stem cells."
Yakubov et al., 2010, Biochemical and Biophysical Research Communications, 394:189-193 (2010). "Reprogramming of human fibroblasts to pluripotent stem cells using mRNA of four transcription factors."
Yisraeli et al., Methods Enzymol., 180:42-50 (1989). "Synthesis of long, capped transcripts in vitro by SP6 and T7 RNA polymerases."
Yoshida et al., Cell Stem Cell, 5:237-241 (2009). "Hypoxia enhances the generation of induced pluripotent stem cells."
Yu et al., Science, 318:1917-1920 (2007). "Induced pluripotent stem cell lines derived from human somatic cells."
Yu et al., Science, 324:797-801 (2009). "Human induced pluripotent stem cells free of vector and transgene sequences."

* cited by examiner

> 2-FOLD UPREGULATED IN MODIFIED-RNA VERSUS

| UNTRANSFECTED | | VEHICLE | |
|---|---|---|---|
| GENE | FOLD CHANGE | GENE | FOLD CHANGE |
| RAP1A | 5.8 | CCL5 | 4.4 |
| IFIT1 | 5.1 | RAP1A | 4.4 |
| CCL5 | 4.6 | CXCL10 | 4.2 |
| CXCL10 | 4.4 | IFIT1 | 4.0 |
| CXCL11 | 3.8 | CXCL11 | 3.4 |
| RP11-167P23.2 | 3.5 | MX1 | 3.2 |
| GALR3 | 3.3 | RP11-167P23.2 | 2.8 |
| MX1 | 3.2 | HERC5 | 2.8 |
| HERC5 | 2.7 | GALR3 | 2.8 |
| IFIT2 | 2.6 | IFIT3 | 2.5 |
| RSAD2 | 2.6 | IFIT2 | 2.5 |
| CDC20 | 2.5 | RSAD2 | 2.4 |
| IFIT3 | 2.5 | IFNB1 | 2.3 |
| OASL | 2.4 | OASL | 2.3 |
| IFNB1 | 2.2 | CDC20 | 2.0 |
| CLDN1 | 2.2 | | |
| DMD1 | 2.1 | | |
| CMPK2 | 2.0 | | |
| DLL4 | 2.0 | | |

KIT FOR MAKING INDUCED PLURIPOTENT STEM CELLS USING MODIFIED RNAS

CROSS-REFERENCE TO RELATED APPLICATIONS

This application is a continuation application under 35 U.S.C. §120 of a co-pending U.S. application Ser. No. 13/088,009 filed on Apr. 15, 2011, which claims benefit under 35 U.S.C. §119(e) of U.S. Provisional Patent Application Ser. No. 61/325,003 filed on Apr. 16, 2010 and U.S. Provisional Patent Application Ser. No. 61/387,220 filed on Sep. 28, 2010, the contents of which are incorporated herein by reference in their entirety.

SEQUENCE LISTING

The instant application contains a Sequence Listing which has been submitted in ASCII format via EFS-Web and is hereby incorporated by reference in its entirety. Said ASCII copy, created on May 10, 2011, is named 67442PCT.txt and is 7,200,768 bytes in size.

FIELD OF THE INVENTION

The field of the invention relates to synthetic, modified RNAs and uses thereof.

BACKGROUND

The ability to change the phenotype of a cell or cells, either to express a desired protein or to change the differentiated phenotype of the cell to that of another, desired cell type, has applications in both research and therapeutic settings. The phenotype of a cell is most commonly modified by expression of protein(s) from exogenous DNA or from recombinant viral vectors. These approaches have the potential for unintended mutagenic effects.

One area of interest is the modification of cellular differentiation such that cells are directed to different developmental lineages. As one example, generating insulin-producing pancreatic β cells from acinar pancreatic cells or other somatic cell types, has the potential to treat diabetes. As but one other example, the ability to redifferentiate a tumor cell or tumor stem cell to a non-cancerous cell type can provide a therapy for cancer. Current protocols for altering cell fate tend to focus on the expression of factors, such as differentiation factors, dedifferentiation factors, transdifferentiation factors, and reprogramming factors, using viral- or DNA-mediated expression.

An area of recent focus is the production of pluripotent or multipotent stem cells from non-embryonic sources. Induction of pluripotency was originally achieved by Yamanaka and colleagues using retroviral vectors to enforce expression of four transcription factors, KLF4, c-MYC, OCT4, and SOX2 (KMOS) (Takahashi, K. and S. Yamanaka, *Cell*, 2006. 126(4): p. 663-76; Takahashi, K., et al., *Cell*, 2007. 131(5): p. 861-72). Attempts to derive induced pluripotent stem (iPS) cells have also been made using excisable lentiviral and transposon vectors, or through repeated application of transient plasmid, episomal, and adenovirus vectors (Chang, C.-W., et al., *Stem Cells*, 2009. 27(5): p. 1042-1049; Kaji, K., et al., *Nature*, 2009. 458(7239): p. 771-5; Okita, K., et al., *Science*, 2008. 322(5903): p. 949-53; Stadtfeld, M., et al., *Science*, 2008. 322(5903): p. 945-9; Woltjen, K., et al., *Nature*, 2009; Yu, J., et al., *Science*, 2009: p. 1172482; Fusaki, N., et al., *Proc Jpn Acad Ser B Phys Biol Sci*, 2009. 85(8): p. 348-62).

Human pluripotent cells have also been derived using two DNA-free methods: serial protein transduction with recombinant proteins incorporating cell-penetrating peptide moieties (Kim, D., et al., *Cell Stem Cell*, 2009. 4(6): p. 472-476; Zhou, H., et al., *Cell Stem Cell*, 2009. 4(5): p. 381-4), and infectious transgene delivery using the Sendai virus, which has a completely RNA-based reproductive cycle (Fusaki, N., et al., *Proc Jpn Acad Ser B Phys Biol Sci*, 2009. 85(8): p. 348-62).

SUMMARY

Provided herein are compositions, methods, and kits for changing the phenotype of a cell or cells. These methods, compositions, and kits can be used either to express a desired protein in a cell or tissue, or to change the differentiated phenotype of a cell to that of another, desired cell type. Significantly, the methods, compositions, and kits described herein do not utilize exogenous DNA or viral vector-based methods for the expression of protein(s), and thus, do not cause permanent modification of the genome or have the potential for unintended mutagenic effects.

The compositions, methods, and kits described herein are based upon the direct introduction of synthetic RNAs into a cell, which, when translated, provide a desired protein or proteins. Higher eukaryotic cells have evolved cellular defenses against foreign, "non-self," RNA that ultimately result in the global inhibition of cellular protein synthesis, resulting in cellular toxicity. This response involves, in part, the production of Type I or Type II interferons, and is generally referred to as the "interferon response" or the "cellular innate immune response." The cellular defenses normally recognize synthetic RNAs as foreign, and induce this cellular innate immune response. The inventors have recognized that the ability to achieve sustained or repeated expression of an exogenously directed protein using synthetic RNA is hampered by the induction of this innate immune response. In the methods described herein, the effect of the cellular innate immune response is mitigated by using synthetic RNAs that are modified in a manner that avoids or reduces the response. Avoidance or reduction of the innate immune response permit sustained expression from exogenously introduced RNA necessary, for example, to modify the developmental phenotype of a cell. In one aspect, sustained expression is achieved by repeated introduction of synthetic, modified RNAs into a target cell or its progeny.

The modified, synthetic RNAs described herein, in one aspect, can be introduced to a cell in order to induce exogenous expression of a protein of interest in a cell. The ability to direct exogenous expression of a protein of interest using the modified, synthetic RNAs described herein is useful, for example, in the treatment of disorders caused by an endogenous genetic defect in a cell or organism that impairs or prevents the ability of that cell or organism to produce the protein of interest. Accordingly, in some embodiments, compositions and methods comprising the modified, synthetic RNAs described herein can be used for the purposes of gene therapy.

The modified, synthetic RNAs described herein can advantageously be used in the alteration of cellular fates and/or developmental potential. The ability to express a protein from an exogenous RNA permits both the alteration or reversal of the developmental potential of a cell, i.e., the reprogramming of the cell, and the directed differentiation of a cell to a more differentiated phenotype. A critical aspect in altering the developmental potential of a cell is the requirement for sustained and prolonged expression of one or more developmental potential altering factors in the cell or its immediate progeny. Traditionally, such sustained expression has been achieved by introducing DNA or viral vectors to a cell. These traditional approaches have limited therapeutic utility due to the potential for insertional mutagenesis. The compositions and methods described herein completely avoid such risks related to genomic alterations.

One of the areas that can most benefit from the ability to express a desired protein or proteins over a sustained period of time from exogenous synthetic, modified RNAs as described herein is the generation of pluripotent or multipotent cells from cells initially having a more differentiated phenotype. In this aspect, synthetic, modified RNAs encoding a reprogramming factor or factors are used to reprogram cells to a less differentiated phenotype, i.e., having a greater developmental potential. Unexpectedly, the inventors have discovered that the synthetic, modified RNAs described herein permit both dramatically enhanced efficiency and rate of cellular reprogramming relative to DNA- or viral vector-mediated reprogramming methods.

A major goal of stem cell technology is to make the stem cell differentiate into a desired cell type, i.e., directed differentiation. Not only are the compositions and methods described herein useful for reprogramming cells, they are also applicable to this directed differentiation of cells to a desired phenotype. That is, the same technology described herein for reprogramming is directly applicable to the differentiation of the reprogrammed cell, or any other stem cell or precursor cell, for that matter, to a desired cell type.

Accordingly, in one aspect, provided herein are synthetic, modified RNA molecules encoding a polypeptide, where the synthetic, modified RNA molecule comprises one or more modifications, such that introducing the synthetic, modified RNA molecule to a cell results in a reduced innate immune response relative to a cell contacted with a synthetic RNA molecule encoding the polypeptide not comprising the one or more modifications.

In some embodiments of this aspect and all such aspects described herein, the synthetic, modified RNA molecule comprises at least two modified nucleosides. In one such embodiment, the two modified nucleosides are selected from the group consisting of 5-methylcytidine (5mC), N6-methyladenosine (m6A), 3,2'-O-dimethyluridine (m4U), 2-thiouridine (s2U), 2' fluorouridine, pseudouridine, 2'-O-methyluridine (Um), 2' deoxy uridine (2' dU), 4-thiouridine (s4U), 5-methyluridine (m5U), 2'-O-methyladenosine (m6A), N6,2'-O-dimethyladenosine (m6Am), N6,N6,2'-β-trimethyladenosine (m62Am), 2'-O-methylcytidine (Cm), 7-methylguanosine (m7G), 2'-O-methylguanosine (Gm), N2,7-dimethylguanosine (m2,7G), N2,N2,7-trimethylguanosine (m2,2,7G), and inosine (I). In one such embodiment of this aspect and all such aspects described herein, the at least two modified nucleosides are 5-methylcytidine (5mC) and pseudouridine.

In some embodiments of this aspect and all such aspects described herein, the synthetic, modified RNA molecule further comprises a 5' cap. In one such embodiment, the 5' cap is a 5' cap analog. In one embodiment, the 5' cap analog is a 5' diguanosine cap.

In some embodiments of this aspect and all such aspects described herein, the synthetic, modified RNA molecule does not comprise a 5' triphosphate.

In some embodiments of this aspect and all such aspects described herein, the synthetic, modified RNA molecule further comprises a poly(A) tail, a Kozak sequence, a 3' untranslated region, a 5' untranslated region, or any combination thereof. In one embodiment, the poly(A) tail, the Kozak sequence, the 3' untranslated region, the 5' untranslated region, or the any combination thereof comprises one or more modified nucleosides.

In some embodiments of this aspect and all such aspects described herein, the synthetic, modified RNA molecule is further treated with an alkaline phosphatase.

In some embodiments of this aspect and all such aspects described herein, the innate immune response comprises expression of a Type I or Type II interferon.

In some embodiments of this aspect and all such aspects described herein, the innate immune response comprises expression of one or more IFN signature genes selected from the group consisting of IFNα, IFNB1, IFIT, OAS1, PKR, RIGI, CCL5, RAP1A, CXCL10, IFIT1, CXCL11, MX1, RP11-167P23.2, HERC5, GALR3, IFIT3, IFIT2, RSAD2, and CDC20.

In another aspect, provided herein is a cell contacted with a synthetic, modified RNA molecule encoding a polypeptide, or a progeny cell of the contacted cell, where the synthetic, modified RNA molecule comprises one or more modifications, such that introducing the synthetic, modified RNA molecule to the cell results in a reduced innate immune response relative to the cell contacted with a synthetic RNA molecule encoding the polypeptide not comprising the one or more modifications.

In some embodiments of this aspect and all such aspects described herein, the synthetic, modified RNA molecule contacted with the cell comprises at least two modified nucleosides. In one such embodiment, the two modified nucleosides are selected from the group consisting of 5-methylcytidine (5mC), N6-methyladenosine (m6A), 3,2'-O-dimethyluridine (m4U), 2-thiouridine (s2U), 2' fluorouridine, pseudouridine, 2'-O-methyluridine (Um), 2' deoxy uridine (2' dU), 4-thiouridine (s4U), 5-methyluridine (m5U), 2'-O-methyladenosine (m6A), N6,2'-O-dimethyladenosine (m6Am), N6,N6,2'-β-trimethyladenosine (m62Am), 2'-O-methylcytidine (Cm), 7-methylguanosine (m7G), 2'-O-methylguanosine (Gm), N2,7-dimethylguanosine (m2,7G), N2,N2,7-trimethylguanosine (m2,2,7G), and inosine (I). In one such embodiment of this aspect and all such aspects described herein, the at least two modified nucleosides are 5-methylcytidine (5mC) and pseudouridine.

In some embodiments of this aspect and all such aspects described herein, the synthetic, modified RNA molecule contacted with the cell further comprises a 5' cap. In one such embodiment, the 5' cap is a 5' cap analog. In one embodiment, the 5' cap analog is a 5' diguanosine cap.

In some embodiments of this aspect and all such aspects described herein, the synthetic, modified RNA molecule contacted with the cell does not comprise a 5' triphosphate.

In some embodiments of this aspect and all such aspects described herein, the synthetic, modified RNA molecule contacted with the cell further comprises a poly(A) tail, a Kozak sequence, a 3' untranslated region, a 5' untranslated region, or any combination thereof. In one embodiment, the poly(A) tail, the Kozak sequence, the 3' untranslated region, the 5' untranslated region, or the any combination thereof comprises one or more modified nucleosides.

In some embodiments of this aspect and all such aspects described herein, the synthetic, modified RNA molecule contacted with the cell is further treated with an alkaline phosphatase.

In some embodiments of this aspect and all such aspects described herein, the innate immune response comprises expression of a Type I or Type II interferon, and the expression of the Type I or Type II interferon is not increased more than three-fold compared to a reference from a cell which has not been contacted with the synthetic modified RNA molecule.

In some embodiments of this aspect and all such aspects described herein, the innate immune response comprises expression of one or more IFN signature genes selected from the group consisting of IFNα, IFNB1, IFIT, OAS1, PKR, RIGI, CCL5, RAP1A, CXCL10, IFIT1, CXCL11, MX1, RP11-167P23.2, HERC5, GALR3, IFIT3, IFIT2, RSAD2, and CDC20, and where the expression of the one of more IFN signature genes is not increased more than six-fold compared to a reference from a cell which has not been contacted with the synthetic modified RNA molecule.

In some embodiments of this aspect and all such aspects described herein, the polypeptide encoded by the synthetic, modified RNA molecule introduced to the cell alters a function or a developmental phenotype of the cell. In some such embodiments, the developmental phenotype is a developmental potential. In some embodiments, the developmental potential is decreased. In some embodiments, the developmental potential is increased.

In some embodiments of this aspect and all such aspects described herein, the polypeptide encoded by the synthetic, modified RNA molecule is a reprogramming factor, a differentiation factor, or a de-differentiation factor.

In another aspect, provided herein is a cell contacted with a synthetic, modified RNA molecule encoding a polypeptide, or a progeny cell of the contacted cell, where expression of the encoded polypeptide in the cell alters a function or a developmental phenotype of the cell, and where the synthetic, modified RNA molecule comprises one or more modifications, such that introducing the synthetic, modified RNA molecule to the cell results in a reduced innate immune response relative to the cell contacted with a synthetic RNA molecule encoding the polypeptide not comprising the one or more modifications.

In some embodiments of this aspect and all such aspects described herein, the developmental phenotype altered by expression of the polypeptide encoded by the synthetic, modified RNA molecule is a developmental potential. In some such embodiments of this aspect, the developmental potential is decreased. In other such embodiments of this aspect, the developmental potential is increased.

In some embodiments of these aspects and all such aspects described herein, the polypeptide encoded by the synthetic, modified RNA molecule is a reprogramming factor, a differentiation factor, or a de-differentiation factor.

In another aspect, provided herein is a pluripotent cell, where the pluripotent cell is not an embryonic stem cell, and where the cell was not induced by viral expression of one or more reprogramming factors, and where the cell, when subjected to an unsupervised hierarchical cluster analysis, clusters more closely to an embryonic stem cell than does a pluripotent cell induced by viral expression of one or more reprogramming factors, exogenous protein introduction of one or more reprogramming factors, small molecule mediated expression or induction of one or more reprogramming factors, or any combination thereof.

In one such aspect, provided herein is pluripotent cell, where the pluripotent cell is not an embryonic stem cell, and where the cell was not induced by viral expression of one or more reprogramming factors, and where the cell subjected to an unsupervised hierarchical cluster analysis clusters more closely to a human embryonic stem cell than does a pluripotent cell induced by viral expression of one or more reprogramming factors.

In some embodiments of these aspects and all such aspects described herein, the unsupervised hierarchical cluster analysis is performed on the pluripotent cells using a Euclidean distance with average linkage method, in which the similarity metric for comparison between different cells is indicated on the height of cluster dendrogram.

In some embodiments of these aspects and all such aspects described herein, the unsupervised hierarchical cluster analysis is performed on the pluripotent cells using a data set selected from the group consisting of gene expression data, protein expression data, DNA methylation data, histone modification data, and microRNA data.

In some embodiments of these aspects and all such aspects described herein, the pluripotent cell is generated from a precursor somatic cell contacted with at least one synthetic, modified RNA encoding a reprogramming factor.

In some embodiments of these aspects and all such aspects described herein, the pluripotent cell is generated from a precursor human somatic cell.

Another aspect provides a cell comprising an exogenously introduced modified, synthetic RNA encoding a developmental potential altering factor.

In some embodiments of this aspect and all such aspects described herein, the cell is a human cell. In other embodiments of this aspect and all such aspects described herein, the cell is not a human cell.

In some embodiments of this aspect and all such aspects described herein, the cell or its immediate precursor cell(s) has been subjected to at least 3 separate rounds of contacting with the exogenously introduced modified synthetic RNA encoding the developmental potential altering factor.

In some embodiments of this aspect and all such aspects described herein, the cell has a reduced expression of a Type I or Type II IFN relative to a cell subjected to at least 3 separate rounds of contacting with an exogenously introduced non-modified, synthetic RNA encoding the developmental potential altering factor.

In some embodiments of this aspect and all such aspects described herein, the cell has a reduced expression of at least one IFN-signature gene relative to a cell subjected to at least 3 separate rounds of contacting with an exogenously introduced non-modified synthetic RNA encoding the developmental potential altering factor.

In one such embodiment of this aspect and all such aspects described herein, the IFN-signature gene is selected from the group consisting of IFNα, IFNB1, IFIT, OAS1, PKR, RIGI, CCL5, RAP1A, CXCL10, IFIT1, CXCL11, MX1, RP11-167P23.2, HERC5, GALR3, IFIT3, IFIT2, RSAD2, and CDC20.

In some embodiments of this aspect and all such aspects described herein, the developmental potential altering factor is a reprogramming factor, a differentiation factor, or a de-differentiation factor.

In one such embodiment of this aspect and all such aspects described herein, the reprogramming factor is selected from the group consisting of: OCT4 (SEQ ID NO: 788), SOX1, SOX 2 (SEQ ID NO: 941 or SEQ ID NO: 1501), SOX 3, SOX15, SOX 18, NANOG, KLF1, KLF 2, KLF 4 (SEQ ID NO: 501), KLF 5, NR5A2, c-MYC (SEQ ID NO: 636), 1-MYC, n-MYC, REM2, TERT, and LIN28 (SEQ ID NO: 524). In some embodiments of this aspect and all such aspects described herein, the reprogramming factor is not c-MYC.

In some embodiments of this aspect and all such aspects described herein, the synthetic, modified RNA molecule encoding the developmental potential altering factor comprises at least two modified nucleosides. In one such embodiment, the two modified nucleosides are selected from the group consisting of 5-methylcytidine (5mC), N6-methyladenosine (m6A), 3,2'-O-dimethyluridine (m4U), 2-thiouridine (s2U), 2' fluorouridine, pseudouridine, 2'-O-methyluridine (Um), 2' deoxy uridine (2' dU), 4-thiouridine (s4U), 5-methyluridine (m5U), 2'-O-methyladenosine (m6A), N6,2'-O-dimethyladenosine (m6Am), N6,N6,2'-O-trimethyladenosine (m62Am), 2'-O-methylcytidine (Cm), 7-methylguanosine (m7G), 2'-O-methylguanosine (Gm), N2,7-dimethylguanosine (m2,7G), N2,N2,7-trimethylguanosine (m2,2,7G), and inosine (I). In one such embodiment of this aspect and all such aspects described herein, the at least two modified nucleosides are 5-methylcytidine (5mC) and pseudouridine.

In some embodiments of this aspect and all such aspects described herein, the synthetic, modified RNA molecule encoding the developmental potential altering factor further comprises a 5' cap. In one such embodiment, the 5' cap is a 5' cap analog. In one embodiment, the 5' cap analog is a 5' diguanosine cap.

In some embodiments of this aspect and all such aspects described herein, the synthetic, modified RNA molecule encoding the developmental potential altering factor does not comprise a 5' triphosphate.

In some embodiments of this aspect and all such aspects described herein, the synthetic, modified RNA molecule encoding the developmental potential altering factor further comprises a poly(A) tail, a Kozak sequence, a 3' untranslated region, a 5' untranslated region, or any combination thereof. In one embodiment, the poly(A) tail, the Kozak sequence, the 3' untranslated region, the 5' untranslated region, or the any combination thereof comprises one or more modified nucleosides.

In some embodiments of this aspect and all such aspects described herein, the synthetic, modified RNA molecule encoding the developmental potential altering factor is further treated with an alkaline phosphatase.

In some embodiments of this aspect and all such aspects described herein, the cell or its immediate precursor cell(s) is derived from a somatic cell, a partially reprogrammed somatic cell, a pluripotent cell, a multipotent cell, a differentiated cell, or an embryonic cell.

In another aspect, provided herein is a composition comprising at least one modified, synthetic RNA encoding a reprogramming factor, and cell growth media.

In some embodiments of this aspect and all such aspects described herein, the composition permits an efficiency of pluripotent cell generation from a starting population of somatic cells of at least 1%.

In some embodiments of this aspect and all such aspects described herein, the composition permits a rate of pluripotent cell generation from a starting population of somatic cells of less than 25 days and greater than 7 days.

In one embodiment of this aspect and all such aspects described herein, the reprogramming factor is selected from the group consisting of: OCT4, SOX1, SOX 2, SOX 3, SOX15, SOX 18, NANOG, KLF1, KLF 2, KLF 4, KLF 5, NR5A2, c-MYC, l-MYC, n-MYC, REM2, TERT, and LIN28. In some embodiments of this aspect and all such aspects described herein, the reprogramming factor is not c-MYC.

In some embodiments of this aspect and all such aspects described herein, the composition comprises at least 3 synthetic, modified, RNAs encoding at least 3 different reprogramming factors. In one such embodiment, the at least 3 different reprogramming factors encoded by the at least 3 synthetic, modified RNAs are selected from the group consisting of OCT4, SOX2, KLF4, c-MYC, and LIN-28.

In some embodiments of this aspect and all such aspects described herein, the synthetic, modified RNA molecule encoding the developmental potential altering factor comprises at least two modified nucleosides. In one such embodiment, the two modified nucleosides are selected from the group consisting of 5-methylcytidine (5mC), N6-methyladenosine (m6A), 3,2'-O-dimethyluridine (m4U), 2-thiouridine (s2U), 2' fluorouridine, pseudouridine, 2'-O-methyluridine (Um), 2' deoxy uridine (2' dU), 4-thiouridine (s4U), 5-methyluridine (m5U), 2'-O-methyladenosine (m6A), N6,2'-O-dimethyladenosine (m6Am), N6,N6,2'-O-trimethyladenosine (m62Am), 2'-O-methylcytidine (Cm), 7-methylguanosine (m7G), 2'-O-methylguanosine (Gm), N2,7-dimethylguanosine (m2,7G), N2,N2,7-trimethylguanosine (m2,2,7G), and inosine (I). In one such embodiment of this aspect and all such aspects described herein, the at least two modified nucleosides are 5-methylcytidine (5mC) and pseudouridine.

In some embodiments of this aspect and all such aspects described herein, the synthetic, modified RNA molecule encoding the developmental potential altering factor further comprises a 5' cap. In one such embodiment, the 5' cap is a 5' cap analog. In one embodiment, the 5' cap analog is a 5' diguanosine cap.

In some embodiments of this aspect and all such aspects described herein, the synthetic, modified RNA molecule encoding the developmental potential altering factor does not comprise a 5' triphosphate.

In some embodiments of this aspect and all such aspects described herein, the synthetic, modified RNA molecule encoding the developmental potential altering factor further comprises a poly(A) tail, a Kozak sequence, a 3' untranslated region, a 5' untranslated region, or any combination thereof. In one embodiment, the poly(A) tail, the Kozak sequence, the 3' untranslated region, the 5' untranslated region, or the any combination thereof comprises one or more modified nucleosides.

In some embodiments of this aspect and all such aspects described herein, the synthetic, modified RNA molecule encoding the developmental potential altering factor is further treated with an alkaline phosphatase.

Another aspect provides a pluripotent cell generated using any of the compositions described herein.

In one aspect, provided herein is a cell composition comprising a pluripotent cell clone isolated from a population of somatic cells contacted a plurality of times with at least one synthetic, modified RNA encoding a developmental potential altering factor.

In some embodiments of this aspect and all such aspects described herein, the population of somatic cells is a population of human somatic cells.

In some embodiments of this aspect and all such aspects described herein, the pluripotent cell clone subjected to an unsupervised hierarchical cluster analysis clusters more closely to a human embryonic stem cell than does a pluripotent cell clone induced by viral expression of one or more reprogramming factors, exogenous protein introduction of one or more reprogramming factors, small molecule mediated expression or induction of one or more reprogramming factors, or any combination thereof.

Provided herein are methods of altering the developmental potential of a cell. In one aspect, the method comprises contacting with or introducing to a cell population or progeny cells thereof at least one synthetic, modified RNA encoding a developmental potential altering factor. In some embodiments of this aspect and all such aspects described herein, the contacting with or introducing to is performed at least three times.

In some embodiments of this aspect and all such aspects described herein, the synthetic, modified RNA molecule encoding the developmental potential altering factor comprises at least two modified nucleosides. In one such embodiment, the two modified nucleosides are selected from the group consisting of 5-methylcytidine (5mC), N6-methyladenosine (m6A), 3,2'-O-dimethyluridine (m4U), 2-thiouridine (s2U), 2' fluorouridine, pseudouridine, 2'-O-methyluridine (Um), 2' deoxy uridine (2' dU), 4-thiouridine (s4U), 5-methyluridine (m5U), 2'-O-methyladenosine (m6A), N6,2'-O-dimethyladenosine (m6Am), N6,N6,2'-O-trimethyladenosine (m62Am), 2'-O-methylcytidine (Cm), 7-methylguanosine (m7G), 2'-O-methylguanosine (Gm), N2,7-dimethylguanosine (m2,7G), N2,N2,7-trimethylguanosine (m2,2,7G), and inosine (I). In one such embodiment of this aspect and all such aspects described herein, the at least two modified nucleosides are 5-methylcytidine (5mC) and pseudouridine.

In some embodiments of this aspect and all such aspects described herein, the synthetic, modified RNA molecule encoding the developmental potential altering factor further comprises a 5' cap. In one such embodiment, the 5' cap is a 5' cap analog. In one embodiment, the 5' cap analog is a 5' diguanosine cap.

In some embodiments of this aspect and all such aspects described herein, the synthetic, modified RNA molecule encoding the developmental potential altering factor does not comprise a 5' triphosphate.

In some embodiments of this aspect and all such aspects described herein, the synthetic, modified RNA molecule encoding the developmental potential altering factor further comprises a poly(A) tail, a Kozak sequence, a 3' untranslated region, a 5' untranslated region, or any combination thereof. In one embodiment, the poly(A) tail, the Kozak sequence, the 3' untranslated region, the 5' untranslated region, or the any combination thereof comprises one or more modified nucleosides.

In some embodiments of this aspect and all such aspects described herein, the synthetic, modified RNA molecule encoding the developmental potential altering factor is further treated with an alkaline phosphatase.

In some embodiments of this aspect and all such aspects described herein, the method further comprises a step of determining that the cell population or progeny cells thereof maintain increased viability by measuring viability of the cell population or progeny cells thereof, where the viability of at least 50% of the contacted cell population or progeny cells thereof indicates that the cells maintain increased viability.

In some embodiments of this aspect and all such aspects described herein, the method further comprises a step of determining that the cell population or progeny cells thereof does not have a significant increase in expression of a Type I or a Type II IFN by measuring expression of a Type I or a Type II IFN in the contacted cell population or progeny cells thereof, where a less than three-fold increase in expression of Type I or Type II IFN in the contacted cell population or progeny cells thereof compared to cells that have not been contacted with the synthetic and modified RNA indicates that the cell population does not have a significant increase in expression of Type I or Type II IFN.

In some such embodiments of this aspect and all such aspects described herein, measuring the expression of Type I or Type II IFN is performed by measuring expression of at least one IFN-signature gene selected from IFNα, IFNB1, IFIT, OAS1, PKR, RIGI, CCL5, RAP1A, CXCL10, IFIT1, CXCL11, MX1, RP11-167P23.2, HERC5, GALR3, IFIT3, IFIT2, RSAD2, and CDC20, where a less than six-fold increase in expression of the at least one IFN-signature gene compared to the cell population or progeny cells thereof prior to contacting the cell population or progeny cells thereof with the at least one modified and synthetic RNA.

In some embodiments of this aspect and all such aspects described herein, contacting of the cell population or progeny cells thereof is performed in vitro, ex vivo, or in vivo.

Also provided herein are methods for reprogramming a somatic cell into a pluripotent cell. In one aspect, the method comprises contacting a somatic cell population or progeny cells thereof with at least one modified, synthetic RNA encoding at least one reprogramming factor at least five consecutive times.

In some embodiments of this aspect and all such aspects described herein, the at least five consecutive times occur within 25 days.

In some embodiments of this aspect and all such aspects described herein, the at least one synthetic, modified RNA encoding the reprogramming factor comprises at least two modified nucleosides. In one such embodiment, the at least two modified nucleosides are selected from the group consisting of 5-methylcytidine (5mC), N6-methyladenosine (m6A), 3,2'-O-dimethyluridine (m4U), 2-thiouridine (s2U), 2' fluorouridine, pseudouridine, 2'-O-methyluridine (Um), 2' deoxy uridine (2' dU), 4-thiouridine (s4U), 5-methyluridine (m5U), 2'-O-methyladenosine (m6A), N6,2'-O-dimethyladenosine (m6Am), N6,N6,2'-O-trimethyladenosine (m62Am), 2'-O-methylcytidine (Cm), 7-methylguanosine (m7G), 2'-O-methylguanosine (Gm), N2,7-dimethylguanosine (m2,7G), N2,N2,7-trimethylguanosine (m2,2,7G), and inosine (I). In one such embodiment, the at least two modified nucleosides are 5-methylcytidine (5mC) and pseudouridine.

In one such embodiment of this aspect and all such aspects described herein, the at least two modified nucleosides are 5-methylcytidine (5mC) and pseudouridine.

In some embodiments of this aspect and all such aspects described herein, the synthetic, modified RNA molecule encoding the reprogramming factor further comprises a 5' cap. In one such embodiment, the 5' cap is a 5' cap analog. In one embodiment, the 5' cap analog is a 5' diguanosine cap.

In some embodiments of this aspect and all such aspects described herein, the synthetic, modified RNA molecule encoding the reprogramming factor does not comprise a 5' triphosphate.

In some embodiments of this aspect and all such aspects described herein, the synthetic, modified RNA molecule encoding the reprogramming factor further comprises a poly (A) tail, a Kozak sequence, a 3' untranslated region, a 5' untranslated region, or any combination thereof. In one embodiment, the poly(A) tail, the Kozak sequence, the 3' untranslated region, the 5' untranslated region, or the any combination thereof comprises one or more modified nucleosides.

In some embodiments of this aspect and all such aspects described herein, the synthetic, modified RNA molecule encoding th reprogramming factor is further treated with an alkaline phosphatase.

In some embodiments of this aspect and all such aspects described herein, the at least one reprogramming factor is selected from: OCT4 (SEQ ID NO: 788), SOX1, SOX 2 (SEQ ID NO: 941 or SEQ ID NO: 1501), SOX 3, SOX15, SOX 18, NANOG, KLF1, KLF 2, KLF 4 (SEQ ID NO: 501), KLF 5, NR5A2, c-MYC (SEQ ID NO: 636), 1-MYC, n-MYC, REM2, TERT, and LIN28 (SEQ ID NO: 524). In some embodiments of this aspect and all such aspects described herein, the reprogramming factor is not c-MYC.

In some embodiments of this aspect and all such aspects described herein, the at least one reprogramming factor comprises a synthetic and modified RNA encoding OCT4, a synthetic and modified RNA encoding SOX2, a synthetic and modified RNA encoding c-MYC, and a synthetic and modified RNA encoding KLF4. In some embodiments of this aspect and all such aspects described herein, the at least one reprogramming factor further comprises a synthetic and modified RNA molecule encoding LIN28.

In some embodiments of this aspect and all such aspects described herein, a combination of at least three reprogramming selected from the group consisting of a synthetic, modified RNA encoding OCT4, a synthetic, modified RNA encoding SOX2, a synthetic, modified RNA encoding c-MYC, a synthetic, modified RNA encoding KLF4, and a synthetic, modified RNA molecule encoding LIN28, are used in the methods described herein.

In some embodiments of this aspect and all such aspects described herein, the method further comprises determining increased reprogramming efficiency of the somatic cell by measuring efficiency of reprogramming, where efficiency of at least 1% is indicative of increased reprogramming efficiency.

In some embodiments of this aspect and all such aspects described herein, the method further comprises a step of determining that the somatic cell or progeny cells thereof maintain increased viability by measuring viability of the somatic cell or progeny cells thereof, where viability of at least 50% of the contacted somatic cell or progeny cells thereof indicates that the cells maintain increased viability.

In some embodiments of this aspect and all such aspects described herein, the method further comprises the step of determining that the reprogrammed somatic cell produced by the method has an increased likeness to the potency of an embryonic stem cell by subjecting the pluripotent cell or pluripotent cell population generated by the method to an unsupervised hierarchical cluster analysis and comparing it to a reference from an unsupervised cluster analysis of a pluripotent cell produced by viral expression of one or more of the reprogramming factors, exogenous protein introduction of one or more reprogramming factors, small molecule mediated expression or induction of one or more reprogramming factors, such that if the reprogrammed somatic cell clusters more closely to an embryonic stem cell than it does to a the reference, it has an increased likeness to the potency of embryonic stem cell.

In some embodiments of this aspect and all such aspects described herein, the method further comprises a step of determining that the reprogrammed somatic cell or progeny cell thereof does not have a significant increase in expression of IFN by measuring expression of at least one IFN-signature gene in the reprogrammed somatic cell or progeny cell thereof, such that if the increase in expression of the at least one IFN-signature gene is less than six-fold compared to a reference from a somatic cell prior to it being subjected to reprogramming indicates that the reprogrammed somatic cell or progeny cell thereof does not have a significant increase in expression of IFN.

In some such embodiments of this aspect and all such aspects described herein, the method further comprises the IFN-signature gene is selected from the group consisting of IFNα, IFNB1, IFIT, OAS1, PKR, RIGI, CCL5, RAP1A, CXCL10, IFIT1, CXCL11, MX1, RP11-167P23.2, HERC5, GALR3, IFIT3, IFIT2, RSAD2, and CDC20.

In some embodiments of this aspect and all such aspects described herein, the somatic cell population or progeny cells thereof are contacted under a low-oxygen condition.

In some embodiments of this aspect and all such aspects described herein, the method further comprises determining that the reprogrammed somatic cell or progeny thereof expresses sufficient levels of genes to determine pluripotency by measuring expression of at least two genes selected from the group consisting of SOX2, REX1, DNMT3B, TRA-1-60, TRA-1-81, SSEA3, SSEA4, OCT4, and NANOG and comparing the result to a reference from an embryonic stem cell, such that if at least two of the genes are expressed at the level they are expressed in the embryonic stem cell, it indicates that the reprogrammed somatic cell or progeny thereof expresses sufficient levels of genes to determine pluripotency.

In some embodiments of this aspect and all such aspects described herein, contacting of the somatic cell population or progeny cells thereof is performed in vitro, ex vivo, or in vivo.

In some embodiments of this aspect and all such aspects described herein, the somatic cell is a human somatic cell.

Other aspects described herein provide methods of treating subjects in need of cellular therapies. In such aspects, an effective amount of a population of any of the progenitor, multipotent, oligopotent, lineage-restricted, fully or partially differentiated cells, generated using any of the compositions or methods comprising synthetic, modified RNAs described herein, is administered to a subject in need of a cellular therapy.

Accordingly, in one aspect, provided herein is a method of treating a subject in need of a cellular therapy, comprising: administering to a subject in need of a cellular therapy an effective amount of a population of cells having altered developmental potential produced by contacting a cell population or progeny cells thereof with at least one synthetic, modified RNA encoding a developmental potential altering factor for at least three consecutive times.

In some embodiments of this aspect and all such aspects described herein, the at least one synthetic and modified RNA encoding a developmental potential altering factor comprises at least two modified nucleosides. In one embodiment of this aspect, the at least two modified nucleosides are selected from the group consisting of 5-methylcytidine (5mC), N6-methyladenosine (m6A), 3,2'-O-dimethyluridine (m4U), 2-thiouridine (s2U), 2' fluorouridine, pseudouridine, 2'-O-methyluridine (Um), 2' deoxy uridine (2' dU), 4-thiouridine (s4U), 5-methyluridine (m5U), 2'-O-methyladenosine (m6A), N6,2'-O-dimethyladenosine (m6Am), N6,N6,2'-O-trimethyladenosine (m62Am), 2'-O-methylcytidine (Cm), 7-methylguanosine (m7G), 2'-O-methylguanosine (Gm), N2,7-dimethylguanosine (m2,7G), N2,N2,7-trimethylguanosine (m2,2,7G), and inosine (I). In one embodiment of this aspect, the at least two modified nucleosides are 5-methylcytidine (5mC) and pseudouridine.

In some embodiments of this aspect and all such aspects described herein, the at least one synthetic and modified RNA encoding a developmental potential altering factor at least one synthetic, modified RNA further comprises a 5' cap. In one embodiment of this aspect, the 5' cap is a 5' cap analog. In one such embodiment, the 5' cap analog is a 5' diguanosine cap.

In some embodiments of this aspect and all such aspects described herein, the at least one synthetic and modified RNA encoding a developmental potential altering factor does not comprise a 5' triphosphate.

In some embodiments of this aspect and all such aspects described herein, the at least one synthetic, modified RNA encoding a developmental potential altering factor further comprises a poly(A) tail, a Kozak sequence, a 3' untranslated region, a 5' untranslated region, or any combination thereof.

In some embodiments of this aspect and all such aspects described herein, the contacting at least three consecutive times are at least 24 hours apart. In some embodiments of this aspect and all such aspects described herein, the contacting at least three consecutive times occur within 15 days.

In some embodiments of this aspect and all such aspects described herein, the method further comprises a step of obtaining an autologous cell from the subject and generating a population of cells having altered developmental potential from the autologous cell by contacting the cell population or progeny cells thereof with at least one synthetic, modified RNA encoding a developmental potential altering factor for at least three consecutive times.

In some embodiments of this aspect and all such aspects described herein, the method further comprises a step of determining that the population of cells having altered developmental potential does not have a significant increase in expression of Type I or Type II IFN prior to administering the population of cells having altered developmental potential to the subject, the step comprising measuring expression of Type I or Type II IFN, where expression that is less than three-fold compared to a reference from a cell that has not been subject to a treatment to alter developmental potential indicates that the population of cells having altered developmental potential does not have a significant increase in expression of Type I or Type II IFN.

In some such embodiments of this aspect and all such aspects described herein, the expression of Type I or Type II IFN expression is measured by measuring expression of at least one IFN-signature gene selected from the group consisting of IFNα, IFNB1, IFIT, OAS1, PKR, RIGI, CCL5, RAP1A, CXCL10, IFIT1, CXCL11, MX1, RP11-167P23.2, HERC5, GALR3, IFIT3, IFIT2, RSAD2, and CDC20, and where increase of less than six-fold of the at least two IFN-signature genes indicates that the population of cells having altered developmental potential does not have a significant increase in expression of Type I or Type II IFN.

In some embodiments of this aspect and all such aspects described herein, the altered developmental potential is pluripotency.

In some such embodiments of this aspect and all such aspects described herein, the developmental potential altering factor is a reprogramming factor selected from the group consisting of: OCT4 (SEQ ID NO: 788), SOX1, SOX 2 (SEQ ID NO: 941 or SEQ ID NO: 1501), SOX 3, SOX15, SOX 18, NANOG, KLF1, KLF 2, KLF 4 (SEQ ID NO: 501), KLF 5, NR5A2, c-MYC (SEQ ID NO: 636), 1-MYC, n-MYC, REM2, TERT, and LIN28 (SEQ ID NO: 524). In some embodiments of this aspect and all such aspects described herein, the reprogramming factor is not c-MYC.

In some embodiments of this aspect and all such aspects described herein, the population of cells having altered developmental potential is of a lineage selected from one of an ecotodermal lineage, a mesodermal lineage, or an endodermal lineage.

In some embodiments of this aspect and all such aspects described herein, the population of cells having altered developmental potential is multipotent. In some embodiments of this aspect and all such aspects described herein, the population of cells having altered developmental potential is oligopotent. In some embodiments of this aspect and all such aspects described herein, the population of cells being administered is partially or fully differentiated.

In some embodiments of this aspect and all such aspects described herein, the population of cells having altered developmental potential is differentiated into at least one differentiated cell population.

Also provided herein are methods for identifying agents that have effects on a cellular phenotype or cellular parameter. In some aspects, provided herein are methods for identifying an agent that has an effect on a cellular phenotype. In one aspect, the method comprises: (a) contacting a cell with a synthetic, modified RNA encoding a polypeptide in an amount and frequency sufficient to alter the phenotype of the cell to that of a desired phenotype; (b) contacting the altered cell with a candidate agent; (c) assaying the desired phenotype in the presence of the candidate agent, where a change in the phenotype in the presence of the candidate agent indicates the agent has an effect on the phenotype.

In some embodiments of this aspect and all such aspects described herein, the polypeptide encoded by the synthetic, modified RNA is a reprogramming factor. In some embodiments of this aspect and all such aspects described herein, the polypeptide encoded by the synthetic, modified RNA is a differentiating factor.

In some embodiments of this aspect and all such aspects described herein, the cell is a pluripotent or multipotent cell.

In some embodiments of this aspect and all such aspects described herein, the cellular phenotype is viability, cell growth, expression of a cell-surface marker, or a functional parameter. In some such embodiments of this aspect and all such aspects described herein, the functional parameter is an electrophysiological parameter, an immunological parameter, or a metabolic parameter. In some embodiments, the metabolic parameter is insulin synthesis or insulin secretion. In some embodiments, the electrophysiological parameter is contractibility.

Also provided herein are kits for altering the phenotype or developmental potential of a cell. In one aspect, provided herein is a kit comprising: a) a container with at least one synthetic, modified RNA molecule comprising at least two modified nucleosides, and b) packaging and instructions therefor.

In some embodiments of this aspect and all such aspects described herein, the kit further comprises a container with cell culture medium.

In some embodiments of this aspect and all such aspects described herein, the kit further comprises an IFN inhibitor. In some embodiments of this aspect and all such aspects described herein, the kit further comprises valproic acid.

In some embodiments of this aspect and all such aspects described herein, the at least one synthetic, modified RNA encodes a developmental potential altering factor.

In some embodiments of this aspect and all such aspects described herein, the developmental potential altering factor is a reprogramming factor, a differentiation factor, or a de-differentiation factor.

In some embodiments of this aspect and all such aspects described herein, the synthetic, modified RNA encoding a reprogramming factor in the container has a concentration of 100 ng/μl. In some such embodiments of this aspect and all such aspects described herein, the reprogramming factor is selected from the group consisting of OCT4 (SEQ ID NO: 788), SOX1, SOX 2 (SEQ ID NO: 941 or SEQ ID NO: 1501), SOX 3, SOX15, SOX 18, NANOG, KLF1, KLF 2, KLF 4 (SEQ ID NO: 501), KLF 5, NR5A2, c-MYC (SEQ ID NO: 636), 1-MYC, n-MYC, REM2, TERT, and LIN28 (SEQ ID NO: 524). In some such embodiments of this aspect and all such aspects described herein, the kit comprises at least three of the reprogramming factors. In some such embodiments of this aspect and all such aspects described herein, the at least three reprogramming factors comprise a synthetic, modified RNA encoding OCT4, a synthetic, modified RNA encoding SOX2, a synthetic, modified RNA encoding c-MYC, and a synthetic, modified RNA encoding KLF4. In some such embodiments of this aspect and all such aspects described herein, such that the total concentration of the reprogramming factors in the container is 100 ng/μl, and where OCT4 is provided in molar excess of about three times the concentration of KLF4, SOX-2, and c-MYC. In some such embodiments of this aspect and all such aspects described herein, the kit further comprises a synthetic, modified RNA molecule encoding LIN28.

In some embodiments of this aspect and all such aspects described herein, the kit does not comprise a synthetic, modified RNA encoding c-MYC.

In some embodiments of this aspect and all such aspects described herein, the at least two modified nucleosides of the synthetic, modified RNA are selected from the group consisting of 5-methylcytidine (5mC), N6-methyladenosine (m6A), 3,2'-O-dimethyluridine (m4U), 2-thiouridine (s2U), 2' fluorouridine, pseudouridine, 2'-O-methyluridine (Um), 2' deoxy uridine (2' dU), 4-thiouridine (s4U), 5-methyluridine (m5U), 2'-O-methyladenosine (m6A), N6,2'-O-dimethyladenosine (m6Am), N6,N6,2'-β-trimethyladenosine (m62Am), 2'-O-methylcytidine (Cm), 7-methylguanosine (m7G), 2'-O-methylguanosine (Gm), N2,7-dimethylguanosine (m2,7G), N2,N2,7-trimethylguanosine (m2,2,7G), and inosine (I). In some embodiments of this aspect and all such aspects described herein, the at least two modified nucleosides are 5-methylcytidine (5mC) and pseudouridine.

In some embodiments of this aspect and all such aspects described herein, the at least one synthetic, modified RNA further comprises a 5' cap. In some such embodiments of this aspect and all such aspects described herein, the 5' cap is a 5' cap analog. In one embodiment of this aspect and all such aspects described herein, the 5' cap analog is a 5' diguanosine cap.

In some embodiments of this aspect and all such aspects described herein, the at least one synthetic, modified RNA does not comprise a 5' triphosphate.

In some embodiments of this aspect and all such aspects described herein, the at least one synthetic and modified RNA further comprises a poly(A) tail, a Kozak sequence, a 3' untranslated region, a 5' untranslated regions, or any combination thereof. In some such embodiments of this aspect and all such aspects described herein, the poly(A) tail, the Kozak sequence, the 3' untranslated region, the 5' untranslated region, or the any combination thereof, comprises one or more modified nucleosides.

In some embodiments of this aspect and all such aspects described herein, the kit further comprises a non-implantable delivery device or an implantable delivery device to deliver the at least one synthetic, modified RNA. In some such embodiments of this aspect and all such aspects described herein, the non-implantable delivery device is a pen device. In some such embodiments, the implantable delivery device is a pump, semi-permanent stent, or reservoir.

Another aspect provides a kit for reprogramming a somatic cell to an induced pluripotent stem cell, the kit comprising: a) a vial comprising a synthetic, modified RNA encoding an OCT4 reprogramming factor and a buffer; b) a vial comprising a synthetic, modified RNA encoding a SOX2 reprogramming factor and a buffer; c) a vial comprising a synthetic, modified RNA encoding a c-MYC reprogramming factor and a buffer; d) a vial comprising a synthetic, modified RNA encoding a KLF4 reprogramming factor and a buffer; and e) packaging and instructions therefor; where each of the synthetic, modified RNAs encoding a reprogramming factor comprise at least two modified nucleosides.

In some embodiments of this aspect and all such aspects described herein, the at least two modified nucleosides are pseudouridine and 5-methylcytodine.

In some embodiments of this aspect and all such aspects described herein, the concentration in the vial of each of the synthetic, modified RNAs encoding reprogramming factors is 100 ng/μl.

In some embodiments of this aspect and all such aspects described herein, the kit further comprises a vial comprising a synthetic, modified RNA molecule encoding a LIN28 reprogramming factor and a buffer.

In some embodiments of this aspect and all such aspects described herein, the buffer is RNase-free TE buffer at pH 7.0.

In some embodiments of this aspect and all such aspects described herein, the kit further a synthetic, modified RNA encoding a positive control.

In one embodiment of those aspects where a kit is provided to induce reprogramming of a somatic cell to an induced pluripotent stem cell, the kit comprises: a vial comprising a synthetic, modified RNA encoding OCT4 and a buffer; a vial comprising a synthetic, modified RNA encoding SOX2 and a buffer; a vial comprising a synthetic, modified RNA encoding c-MYC and a buffer; a vial comprising a synthetic, modified RNA encoding KLF4 and a buffer; a vial comprising a synthetic, modified RNA molecule encoding LIN28 and a buffer; a vial comprising a synthetic, modified RNA encoding a positive control GFP molecule; and packaging and instructions therefor; where the buffers in each of the vials is RNase-free TE buffer at pH 7.0; and where the synthetic, modified RNAs encoding OCT4, SOX2, c-MYC, KLF-4, LIN28 and GFP all comprise pseudouridine and 5-methylcytidine nucleoside modifications. In one embodiment, the concentration of the synthetic, modified RNAs encoding OCT4, SOX2, c-MYC, KLF-4, LIN28 and GFP in each of the vials is 100 ng/μl.

Also provided, in another aspect, is a kit for reprogramming a somatic cell to an induced pluripotent stem cell, the kit comprising: a) a container comprising a synthetic, modified RNA encoding an OCT4 reprogramming factor; a synthetic, modified RNA encoding a SOX2 reprogramming factor; a synthetic, modified RNA encoding a c-MYC reprogramming factor; a synthetic, modified RNA encoding a KLF4 reprogramming factor; and a buffer, where each of the synthetic, modified RNAs encoding a reprogramming factor comprises at least two modified nucleosides; and b) packaging and instructions therefor.

In some embodiments of this aspect and all such aspects described herein, the at least two modified nucleosides are pseudouridine and 5-methylcytodine.

In some embodiments of this aspect and all such aspects described herein, the concentration in the container of the synthetic, modified RNAs encoding reprogramming factors is 100 ng/μl.

In some embodiments of this aspect and all such aspects described herein, the kit further comprises a synthetic, modified RNA molecule encoding a LIN28 reprogramming actor.

In some embodiments of this aspect and all such aspects described herein, the kit further comprises a synthetic, modified RNA encoding a positive control.

In some embodiments of this aspect and all such aspects described herein, the buffer is RNase-free TE buffer at pH 7.0.

In some embodiments of this aspect and all such aspects described herein, each of the synthetic, modified RNAs encoding a reprogramming factor further comprise a ligand.

In some such embodiments of this aspect and all such aspects described herein, the ligand is a lipid or lipid-based molecule.

DEFINITIONS

For convenience, certain terms employed herein, in the specification, examples and appended claims are collected here. Unless stated otherwise, or implicit from context, the following terms and phrases include the meanings provided below. Unless explicitly stated otherwise, or apparent from context, the terms and phrases below do not exclude the meaning that the term or phrase has acquired in the art to which it pertains. The definitions are provided to aid in describing particular embodiments, and are not intended to limit the claimed invention, because the scope of the invention is limited only by the claims. Unless otherwise defined, all technical and scientific terms used herein have the same meaning as commonly understood by one of ordinary skill in the art to which this invention belongs.

As used herein, the terms "developmental potential" or "developmental potency" refer to the total of all developmental cell fates or cell types that can be achieved by a cell upon differentiation. Thus, a cell with greater or higher developmental potential can differentiate into a greater variety of different cell types than a cell having a lower or decreased developmental potential. The developmental potential of a cell can range from the highest developmental potential of a totipotent cell, which, in addition to being able to give rise to all the cells of an organism, can give rise to extra-embryonic tissues; to a "unipotent cell," which has the capacity to differentiate into only one type of tissue or cell type, but has the property of self-renewal, as described herein; to a "terminally differentiated cell," which has the lowest developmental potential. A cell with "parental developmental potential" refers to a cell having the developmental potential of the parent cell that gave rise to it.

The term "totipotency" refers to a cell with a developmental potential to make all of the cells in the adult body as well as the extra-embryonic tissues, including the placenta. The fertilized egg (zygote) is totipotent, as are the cells (blastomeres) of the morula (up to the 16-cell stage following fertilization).

The term "pluripotent" as used herein refers to a cell with the developmental potential, under different conditions, to differentiate to cell types characteristic of all three germ cell layers, i.e., endoderm (e.g., gut tissue), mesoderm (including blood, muscle, and vessels), and ectoderm (such as skin and nerve). A pluripotent cell has a lower developmental potential than a totipotent cell. The ability of a cell to differentiate to all three germ layers can be determined using, for example, a nude mouse teratoma formation assay. In some embodiments, pluripotency can also evidenced by the expression of embryonic stem (ES) cell markers, although the preferred test for pluripotency of a cell or population of cells generated using the compositions and methods described herein is the demonstration that a cell has the developmental potential to differentiate into cells of each of the three germ layers. In some embodiments, a pluripotent cell is termed an "undifferentiated cell." Accordingly, the terms "pluripotency" or a "pluripotent state" as used herein refer to the developmental potential of a cell that provides the ability for the cell to differentiate into all three embryonic germ layers (endoderm, mesoderm and ectoderm). Those of skill in the art are aware of the embryonic germ layer or lineage that gives rise to a given cell type. A cell in a pluripotent state typically has the potential to divide in vitro for a long period of time, e.g., greater than one year or more than 30 passages.

The term "multipotent" when used in reference to a "multipotent cell" refers to a cell that has the developmental potential to differentiate into cells of one or more germ layers, but not all three. Thus, a multipotent cell can also be termed a "partially differentiated cell." Multipotent cells are well known in the art, and examples of multipotent cells include adult stem cells, such as for example, hematopoietic stem cells and neural stem cells. "Multipotent" indicates that a cell may form many types of cells in a given lineage, but not cells of other lineages. For example, a multipotent hematopoietic cell can form the many different types of blood cells (red, white, platelets, etc. . . . ), but it cannot form neurons. Accordingly, the term "multipotency" refers to a state of a cell with a degree of developmental potential that is less than totipotent and pluripotent.

The terms "stem cell" or "undifferentiated cell" as used herein, refer to a cell in an undifferentiated or partially differentiated state that has the property of self-renewal and has the developmental potential to differentiate into multiple cell types, without a specific implied meaning regarding developmental potential (i.e., totipotent, pluripotent, multipotent, etc.). A stem cell is capable of proliferation and giving rise to more such stem cells while maintaining its developmental potential. In theory, self-renewal can occur by either of two major mechanisms. Stem cells can divide asymmetrically, which is known as obligatory asymmetrical differentiation, with one daughter cell retaining the developmental potential of the parent stem cell and the other daughter cell expressing some distinct other specific function, phenotype and/or developmental potential from the parent cell. The daughter cells themselves can be induced to proliferate and produce progeny that subsequently differentiate into one or more mature cell types, while also retaining one or more cells with parental developmental potential. A differentiated cell may derive from a multipotent cell, which itself is derived from a multipotent cell, and so on. While each of these multipotent cells may be considered stem cells, the range of cell types each such stem cell can give rise to, i.e., their developmental potential, can vary considerably. Alternatively, some of the stem cells in a population can divide symmetrically into two stem cells, known as stochastic differentiation, thus maintaining some stem cells in the population as a whole, while other cells in the population give rise to differentiated progeny only. Accordingly, the term "stem cell" refers to any subset of cells that have the developmental potential, under particular circumstances, to differentiate to a more specialized or differentiated phenotype, and which retain the capacity, under certain circumstances, to proliferate without substantially differentiating. In some embodiments, the term stem cell refers generally to a naturally occurring parent cell whose descendants (progeny cells) specialize, often in different directions, by differentiation, e.g., by acquiring completely individual characters, as occurs in progressive diversification of embryonic cells and tissues. Some differentiated cells also have the capacity to give rise to cells of greater developmental potential. Such capacity may be natural or may be induced artificially upon treatment with various factors. Cells that begin as stem cells might proceed toward a differentiated phenotype, but then can be induced to "reverse" and re-express the stem cell phenotype, a term often referred to as "dedifferentiation" or "reprogramming" or "retrodifferentiation" by persons of ordinary skill in the art.

The term "embryonic stem cell" as used herein refers to naturally occurring pluripotent stem cells of the inner cell mass of the embryonic blastocyst (see, for e.g., U.S. Pat. Nos. 5,843,780; 6,200,806; 7,029,913; 7,584,479, which are incorporated herein by reference). Such cells can similarly be obtained from the inner cell mass of blastocysts derived from somatic cell nuclear transfer (see, for example, U.S. Pat. Nos. 5,945,577, 5,994,619, 6,235,970, which are incorporated herein by reference). Embryonic stem cells are pluripotent and give rise during development to all derivatives of the three primary germ layers: ectoderm, endoderm and mesoderm. In other words, they can develop into each of the more than 200 cell types of the adult body when given sufficient and necessary stimulation for a specific cell type. They do not contribute to the extra-embryonic membranes or the placenta, i.e., are not totipotent.

As used herein, the distinguishing characteristics of an embryonic stem cell define an "embryonic stem cell phenotype." Accordingly, a cell has the phenotype of an embryonic stem cell if it possesses one or more of the unique characteristics of an embryonic stem cell, such that that cell can be distinguished from other cells not having the embryonic stem cell phenotype. Exemplary distinguishing embryonic stem cell phenotype characteristics include, without limitation, expression of specific cell-surface or intracellular markers, including protein and microRNAs, gene expression profiles, methylation profiles, deacetylation profiles, proliferative capacity, differentiation capacity, karyotype, responsiveness to particular culture conditions, and the like. In some embodiments, the determination of whether a cell has an "embryonic stem cell phenotype" is made by comparing one or more characteristics of the cell to one or more characteristics of an embryonic stem cell line cultured within the same laboratory.

The term "somatic stem cell" is used herein to refer to any pluripotent or multipotent stem cell derived from non-embryonic tissue, including fetal, juvenile, and adult tissue. Natural somatic stem cells have been isolated from a wide variety of adult tissues including blood, bone marrow, brain, olfactory epithelium, skin, pancreas, skeletal muscle, and cardiac muscle. Each of these somatic stem cells can be characterized based on gene expression, factor responsiveness, and morphology in culture. Exemplary naturally occurring somatic stem cells include, but are not limited to, neural stem cells, neural crest stem cells, mesenchymal stem cells, hematopoietic stem cells, and pancreatic stem cells. In some aspects described herein, a "somatic pluripotent cell" refers to a somatic cell, or a progeny cell of the somatic cell, that has had its developmental potential altered, i.e., increased, to that of a pluripotent state by contacting with, or the introduction of, one or more reprogramming factors using the compositions and methods described herein.

The term "progenitor cell" is used herein to refer to cells that have greater developmental potential, i.e., a cellular phenotype that is more primitive (e.g., is at an earlier step along a developmental pathway or progression) relative to a cell which it can give rise to by differentiation. Often, progenitor cells have significant or very high proliferative potential. Progenitor cells can give rise to multiple distinct cells having lower developmental potential, i.e., differentiated cell types, or to a single differentiated cell type, depending on the developmental pathway and on the environment in which the cells develop and differentiate.

As used herein, the term "somatic cell" refers to any cell other than a germ cell, a cell present in or obtained from a pre-implantation embryo, or a cell resulting from proliferation of such a cell in vitro. Stated another way, a somatic cell refers to any cell forming the body of an organism, as opposed to a germline cell. In mammals, germline cells (also known as "gametes") are the spermatozoa and ova which fuse during fertilization to produce a cell called a zygote, from which the entire mammalian embryo develops. Every other cell type in the mammalian body—apart from the sperm and ova, the cells from which they are made (gametocytes) and undifferentiated, pluripotent, embryonic stem cells—is a somatic cell: internal organs, skin, bones, blood, and connective tissue are all made up of somatic cells. In some embodiments the somatic cell is a "non-embryonic somatic cell," by which is meant a somatic cell that is not present in or obtained from an embryo and does not result from proliferation of such a cell in vitro. In some embodiments the somatic cell is an "adult somatic cell," by which is meant a cell that is present in or obtained from an organism other than an embryo or a fetus or results from proliferation of such a cell in vitro. Unless otherwise indicated, the compositions and methods for reprogramming a somatic cell described herein can be performed both in vivo and in vitro (where in vivo is practiced when a somatic cell is present within a subject, and where in vitro is practiced using an isolated somatic cell maintained in culture).

The term "differentiated cell" encompasses any somatic cell that is not, in its native form, pluripotent, as that term is defined herein. Thus, the term a "differentiated cell" also encompasses cells that are partially differentiated, such as multipotent cells, or cells that are stable, non-pluripotent partially reprogrammed, or partially differentiated cells, generated using any of the compositions and methods described herein. In some embodiments, a differentiated cell is a cell that is a stable intermediate cell, such as a non-pluripotent, partially reprogrammed cell. It should be noted that placing many primary cells in culture can lead to some loss of fully differentiated characteristics. Thus, simply culturing such differentiated or somatic cells does not render these cells non-differentiated cells (e.g. undifferentiated cells) or pluripotent cells. The transition of a differentiated cell (including stable, non-pluripotent partially reprogrammed cell intermediates) to pluripotency requires a reprogramming stimulus beyond the stimuli that lead to partial loss of differentiated character upon placement in culture. Reprogrammed and, in some embodiments, partially reprogrammed cells, also have the characteristic of having the capacity to undergo extended passaging without loss of growth potential, relative to parental cells having lower developmental potential, which generally have capacity for only a limited number of divisions in culture. In some embodiments, the term "differentiated cell" also refers to a cell of a more specialized cell type (i.e., decreased developmental potential) derived from a cell of a less specialized cell type (i.e., increased developmental potential) (e.g., from an undifferentiated cell or a reprogrammed cell) where the cell has undergone a cellular differentiation process.

The term "reprogramming" as used herein refers to a process that reverses the developmental potential of a cell or population of cells (e.g., a somatic cell). Stated another way, reprogramming refers to a process of driving a cell to a state with higher developmental potential, i.e., backwards to a less differentiated state. The cell to be reprogrammed can be either partially or terminally differentiated prior to reprogramming. In some embodiments of the aspects described herein, reprogramming encompasses a complete or partial reversion of the differentiation state, i.e., an increase in the developmental potential of a cell, to that of a cell having a pluripotent state. In some embodiments, reprogramming encompasses driving a somatic cell to a pluripotent state, such that the cell has the developmental potential of an embryonic stem cell, i.e., an embryonic stem cell phenotype. In some embodiments, reprogramming also encompasses a partial reversion of the differentiation state or a partial increase of the developmental potential of a cell, such as a somatic cell or a unipotent cell, to a multipotent state. Reprogramming also encompasses partial reversion of the differentiation state of a cell to a state that renders the cell more susceptible to complete reprogramming to a pluripotent state when subjected to additional manipulations, such as those described herein. Such manipulations can result in endogenous expression of particular genes by the cells, or by the progeny of the cells, the expression of which contributes to or maintains the reprogramming. In certain embodiments, reprogramming of a cell using the synthetic, modified RNAs and methods thereof described herein causes the cell to assume a multipotent state (e.g., is a multipotent cell). In some embodiments, reprogramming of a cell (e.g. a somatic cell) using the synthetic, modified RNAs and methods thereof described herein causes the cell to assume a pluripotent-like state or an embryonic stem cell phenotype. The resulting cells are referred to herein as "reprogrammed cells," "somatic pluripotent cells," and "RNA-induced somatic pluripotent cells." The term "partially reprogrammed somatic cell" as referred to herein refers to a cell which has been reprogrammed from a cell with lower developmental potential by the methods as disclosed herein, such that the partially reprogrammed cell has not been completely reprogrammed to a pluripotent state but rather to a non-pluripotent, stable intermediate state. Such a partially reprogrammed cell can have a developmental potential lower that a pluripotent cell, but higher than a multipotent cell, as those terms are defined herein. A partially reprogrammed cell can, for example, differentiate into one or two of the three germ layers, but cannot differentiate into all three of the germ layers.

The term "developmental potential altering factor," as used herein, refers to a factor such as a protein or RNA, the expression of which alters the developmental potential of a cell, e.g., a somatic cell, to another developmental state, e.g., a pluripotent state. Such an alteration in the developmental potential can be a decrease (i.e., to a more differentiated developmental state) or an increase (i.e., to a less differentiated developmental state). A developmental potential altering factor, can be for example, an RNA or protein product of a gene encoding a reprogramming factor, such as SOX2, an RNA or protein product of a gene encoding a cell-type specific polypeptide transcription factor, such as myoD, a microRNA, a small molecule, and the like.

The term a "reprogramming factor," as used herein, refers to a developmental potential altering factor, as that term is defined herein, such as a protein, RNA, or small molecule, the expression of which contributes to the reprogramming of a cell, e.g. a somatic cell, to a less differentiated or undifferentiated state, e.g. to a cell of a pluripotent state or partially pluripotent state. A reprogramming factor can be, for example, transcription factors that can reprogram cells to a pluripotent state, such as SOX2, OCT3/4, KLF4, NANOG, LIN-28, c-MYC, and the like, including as any gene, protein, RNA or small molecule, that can substitute for one or more of these in a method of reprogramming cells in vitro. In some embodiments, exogenous expression of a reprogramming factor, using the synthetic modified RNAs and methods thereof described herein, induces endogenous expression of one or more reprogramming factors, such that exogenous expression of one or more reprogramming factors is no longer required for stable maintenance of the cell in the reprogrammed or partially reprogrammed state. "Reprogramming to a pluripotent state in vitro" is used herein to refer to in vitro reprogramming methods that do not require and/or do not include nuclear or cytoplasmic transfer or cell fusion, e.g., with oocytes, embryos, germ cells, or pluripotent cells. A reprogramming factor can also be termed a "de-differentiation factor," which refers to a developmental potential altering factor, as that term is defined herein, such as a protein or RNA, that induces a cell to de-differentiate to a less differentiated phenotype, that is a de-differentiation factor increases the developmental potential of a cell.

As used herein, the term "differentiation factor" refers to a developmental potential altering factor, as that term is defined herein, such as a protein, RNA, or small molecule, that induces a cell to differentiate to a desired cell-type, i.e., a differentiation factor reduces the developmental potential of a cell. In some embodiments, a differentiation factor can be a cell-type specific polypeptide, however this is not required. Differentiation to a specific cell type can require simultaneous and/or successive expression of more than one differentiation factor. In some aspects described herein, the developmental potential of a cell or population of cells is first increased via reprogramming or partial reprogramming using synthetic, modified RNAs, as described herein, and then the cell or progeny cells thereof produced by such reprogramming are induced to undergo differentiation by contacting with, or introducing, one or more synthetic, modified RNAs encoding differentiation factors, such that the cell or progeny cells thereof have decreased developmental potential.

In the context of cell ontogeny, the term "differentiate", or "differentiating" is a relative term that refers to a developmental process by which a cell has progressed further down a developmental pathway than its immediate precursor cell. Thus in some embodiments, a reprogrammed cell as the term is defined herein, can differentiate to a lineage-restricted precursor cell (such as a mesodermal stem cell), which in turn can differentiate into other types of precursor cells further down the pathway (such as a tissue specific precursor, for example, a cardiomyocyte precursor), and then to an end-stage differentiated cell, which plays a characteristic role in a certain tissue type, and may or may not retain the capacity to proliferate further.

As used herein, the term "cell-type specific polypeptide" refers to a polypeptide that is expressed in a cell having a particular phenotype (e.g., a muscle cell, a pancreatic (3 cell) but is not generally expressed in other cell types with different phenotypes. As but one example, MyoD is expressed specifically in muscle cells but not in non-muscle cells, thus MyoD is a cell-type specific polypeptide.

As used herein, the term "without the formation of a pluripotent intermediate cell" refers to the transdifferentiation of one cell type to another cell type, preferably, in one step; thus a method that modifies the differentiated phenotype or developmental potential of a cell without the formation of a pluripotent intermediate cell does not require that the cell be first dedifferentiated (or reprogrammed) and then differentiated to another cell type. Instead, the cell type is merely "switched" from one cell type to another without going through a less differentiated phenotype. Accordingly, transdifferentiation refers to a change in the developmental potential of a cell whereby the cell is induced to become a different cell having a similar developmental potential, e.g., a liver cell to a pancreatic cell, a pancreatic a cell into a pancreatic β cell, etc.

The term "expression" refers to the cellular processes involved in producing RNA and proteins and as appropriate, secreting proteins, including where applicable, but not limited to, for example, transcription, translation, folding, modification and processing. "Expression products" include RNA transcribed from a gene, and polypeptides obtained by translation of mRNA transcribed from a gene. In some embodiments, an expression product is transcribed from a sequence that does not encode a polypeptide, such as a microRNA.

As used herein, the term "transcription factor" refers to a protein that binds to specific parts of DNA using DNA binding domains and is part of the system that controls the transcription of genetic information from DNA to RNA.

As used herein, the term "small molecule" refers to a chemical agent which can include, but is not limited to, a peptide, a peptidomimetic, an amino acid, an amino acid analog, a polynucleotide, a polynucleotide analog, an aptamer, a nucleotide, a nucleotide analog, an organic or inorganic compound (e.g., including heterorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds.

The term "exogenous" as used herein refers to a nucleic acid (e.g., a synthetic, modified RNA encoding a transcription factor), or a protein (e.g., a transcription factor) that has been introduced by a process involving the hand of man into a biological system such as a cell or organism in which it is not normally found, or in which it is found in lower amounts. A factor (e.g. a synthetic, modified RNA encoding a transcription factor, or a protein, e.g., a polypeptide) is considered exogenous if it is introduced into an immediate precursor cell or a progeny cell that inherits the substance. In contrast, the term "endogenous" refers to a factor or expression product that is native to the biological system or cell (e.g., endogenous expression of a gene, such as, e.g., SOX2 refers to production of a SOX2 polypeptide by the endogenous gene in a cell). In some embodiments, the introduction of one or more exogenous factors to a cell, e.g., a developmental potential altering factor, using the compositions and methods comprising synthetic, modified RNAs described herein, induces endogenous expression in the cell or progeny cell(s) thereof of a factor or gene product necessary for maintenance of the cell or progeny cell(s) thereof in a new developmental potential.

The term "isolated" or "partially purified" as used herein refers, in the case of a nucleic acid or polypeptide, to a nucleic acid or polypeptide separated from at least one other component (e.g., nucleic acid or polypeptide) that is present with the nucleic acid or polypeptide as found in its natural source and/or that would be present with the nucleic acid or polypeptide when expressed by a cell, or secreted in the case of secreted polypeptides. A chemically synthesized nucleic acid or polypeptide or one synthesized using in vitro transcription/translation is considered "isolated".

The term "isolated cell" as used herein refers to a cell that has been removed from an organism in which it was originally found, or a descendant of such a cell. Optionally the cell has been cultured in vitro, e.g., in the presence of other cells. Optionally, the cell is later introduced into a second organism or re-introduced into the organism from which it (or the cell or population of cells from which it descended) was isolated.

The term "isolated population" with respect to an isolated population of cells as used herein refers to a population of cells that has been removed and separated from a mixed or heterogeneous population of cells. In some embodiments, an isolated population is a "substantially pure" population of cells as compared to the heterogeneous population from which the cells were isolated or enriched. In some embodiments, the isolated population is an isolated population of pluripotent cells which comprise a substantially pure population of pluripotent cells as compared to a heterogeneous population of somatic cells from which the pluripotent cells were derived.

The term "immediate precursor cell" is used herein to refer to a parental cell from which a daughter cell has arisen by cell division.

As used herein, the terms "synthetic, modified RNA" or "modified RNA" refer to an RNA molecule produced in vitro, which comprise at least one modified nucleoside as that term is defined herein below. The synthetic, modified RNA composition does not encompass mRNAs that are isolated from natural sources such as cells, tissue, organs etc., having those modifications, but rather only synthetic, modified RNAs that are synthesized using in vitro techniques. The term "composition," as applied to the terms "synthetic, modified RNA" or "modified RNA," encompasses a plurality of different synthetic, modified RNA molecules (e.g., at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 25, at least 30, at least 40, at least 50, at least 75, at least 90, at least 100 synthetic, modified RNA molecules or more). In some embodiments, a synthetic, modified RNA composition can further comprise other agents (e.g., an inhibitor of interferon expression or activity, a transfection reagent, etc.). Such a plurality can include synthetic, modified RNA of different sequences (e.g., coding for different polypeptides), synthetic, modified RNAs of the same sequence with differing modifications, or any combination thereof.

As used herein the term "modified nucleoside" refers to a ribonucleoside that encompasses modification(s) relative to the standard guanine (G), adenine (A), cytidine (C), and uridine (U) nucleosides. Such modifications can include, for example, modifications normally introduced post-transcriptionally to mammalian cell mRNA, and artificial chemical modifications, as known to one of skill in the art.

As used herein, the term "polypeptide" refers to a polymer of amino acids comprising at least 2 amino acids (e.g., at least 5, at least 10, at least 20, at least 30, at least 40, at least 50, at least 60, at least 70, at least 80, at least 90, at least 100, at least 125, at least 150, at least 175, at least 200, at least 225, at least 250, at least 275, at least 300, at least 350, at least 400, at least 450, at least 500, at least 600, at least 700, at least 800, at least 900, at least 1000, at least 2000, at least 3000, at least 4000, at least 5000, at least 6000, at least 7000, at least 8000, at least 9000, at least 10,000 amino acids or more). The terms "protein" and "polypeptide" are used interchangeably herein. As used herein, the term "peptide" refers to a relatively short polypeptide, typically between about 2 and 60 amino acids in length.

As used herein, the term "added co-transcriptionally" refers to the addition of a feature, e.g., a 5' diguanosine cap or other modified nucleoside, to a synthetic, modified RNA during transcription of the RNA molecule (i.e., the modified RNA is not fully transcribed prior to the addition of the 5' cap).

The term "contacting" or "contact" as used herein in connection with contacting a cell with one or more synthetic, modified RNAs as described herein, includes subjecting a cell to a culture medium which comprises one or more synthetic, modified RNAs at least one time, or a pluarlity of times, or to a method whereby such a synthetic, modified RNA is forced to contact a cell at least one time, or a pluarlity of times, i.e., a transfection system. Where such a cell is in vivo, contacting the cell with a synthetic, modified RNA includes administering the synthetic, modified RNA in a composition, such as a pharmaceutical composition, to a subject via an appropriate administration route, such that the compound contacts the cell in vivo.

The term "transfection" as used herein refers the use of methods, such as chemical methods, to introduce exogenous nucleic acids, such as the synthetic, modified RNAs described herein, into a cell, preferably a eukaryotic cell. As used herein, the term transfection does not encompass viral-based methods of introducing exogenous nucleic acids into a cell. Methods of transfection include physical treatments (electroporation, nanoparticles, magnetofection), and chemical-based transfection methods. Chemical-based transfection methods include, but are not limited to, cyclodextrin, polymers, liposomes, and nanoparticles. In some embodiments, cationic lipids or mixtures thereof can be used to transfect the synthetic, modified RNAs described herein, into a cell, such as DOPA, Lipofectamine and UptiFectin. In some embodiments, cationic polymers such as DEAE-dextran or polyethylenimine, can be used to transfect a synthetic, modified RNAs described herein.

The term "transduction" as used herein refers to the use of viral particles or viruses to introduce exogenous nucleic acids into a cell.

As used herein, the term "transfection reagent" refers to any agent that induces uptake of a synthetic, modified RNA into a host cell. Also encompassed are agents that enhance uptake e.g., by at least 10%, at least 20%, at least 30%, at least 40%, at least 50%, at least 60%, at least 70%, at least 80%, at least 90%, at least 95%, at least 99%, at least 1-fold, at least 2-fold, at least 5-fold, at least 10-fold, at least 25-fold, at least 500-fold, at least 100-fold, at least 1000-fold, or more, compared to a synthetic, modified RNA administered in the absence of such a reagent. In one embodiment, a cationic or non-cationic lipid molecule useful for preparing a composition or for co-administration with a synthetic, modified RNA is used as a transfection reagent. In other embodiments, the synthetic, modified RNA comprises a chemical linkage to attach e.g., a ligand, a peptide group, a lipophillic group, a targeting moiety etc. In other embodiments, the transfection reagent comprises a charged lipid, an emulsion, a liposome, a cationic or non-cationic lipid, an anionic lipid, or a penetration enhancer as known in the art or described herein.

As used herein, the term "repeated transfections" refers to repeated transfection of the same cell culture with a synthetic, modified RNA a plurality of times (e.g., more than once or at least twice). In some embodiments, the cell culture is transfected at least twice, at least 3 times, at least 4 times, at least 5 times, at least 6 times, at least 7 times, at least 8 times, at least 9 times, at least 10 times, at least 11 times, at least 12 times, at least 13 times, at least 14 times, at least 15 times, at least 16 times, at least 17 times at least 18 times, at least 19 times, at least 20 times, at least 25 times, at least 30 times, at least 35 times, at least 40 times, at least 45 times, at least 50 times or more. The transfections can be repeated until a desired phenotype of the cell is achieved.

The time between each repeated transfection is referred to herein as the "frequency of transfection." In some embodiments, the frequency of transfection occurs every 6 h, every 12 h, every 24 h, every 36 h, every 48 h, every 60 h, every 72 h, every 96 h, every 108 h, every 5 days, every 7 days, every 10 days, every 14 days, every 3 weeks, or more during a given time period in any developmental potential altering regimen, such as a reprogramming, transdifferentiation or differentiation regimen. The frequency can also vary, such that the interval between each dose is different (e.g., first interval 36 h, second interval 48 h, third interval 72 h etc). It should be understood depending upon the schedule and duration of repeated transfections, it will often be necessary to split or passage cells or change or replace the media during the transfection regimen to prevent overgrowth and replace nutrients.

For the purposes of the methods described herein, transfections of a culture resulting from passaging an earlier transfected culture is considered "repeated transfection," "repeated contacting" or "contacting a plurality of times," unless specifically indicated otherwise.

As used herein, the term "permits repeated transfections" refers to a synthetic, modified RNA or synthetic, modified RNA composition that can be transfected into a given cell culture with reduced cytotoxicity compared to an RNA or RNA composition having the same sequence(s) which lacks modifications to the RNA. As used herein, the term "reduced cytotoxicity" refers to the death of less than 50% of the cells in a cell culture repeatedly transfected with a synthetic, modified RNA or synthetic, modified RNA composition, e.g., less than 40%, less than 30%, less than 20%, less than 10%, less than 5%, less than 1%, less than 0.1% or fewer compared to transfection with a composition having the same sequence(s) but lacking modifications to the RNA. The amount of cell death in a culture can be determined using a standard Trypan Blue Exclusion assay, which turns dead cells blue while leaving living cells uncolored. Alternatively "reduced cytotoxicity" can be assessed by measuring apoptosis using e.g., a TUNEL assay. Other useful measures for determining "reduced cytotoxicity" include e.g., flow cytometric and bead based measurements of viability, cell growth, cellularity (measured e.g., microscopically and quantitated by a hemocytometer), global protein production, secretion of cytokines (e.g., Type 1 IFNs), and expression level of interferon response signature genes (e.g., IFIT1, IFITM1, OAS1, IFNα1, IFNB1, PKR, RIG-I, TLR7, TLR8 etc).

As used herein, the term "targeting moiety" refers to an agent that homes to or preferentially associates or binds to a particular tissue, cell type, receptor, infecting agent or other area of interest. The addition of a targeting moiety to an RNA delivery composition will enhance the delivery of the composition to a desired cell type or location. The addition to, or expression of, a targeting moiety in a cell enhances the localization of that cell to a desired location within an animal or subject.

As used herein, the terms "innate immune response" or "interferon response" refers to a cellular defense response initiated by a cell in response to recognition of infection by a foreign organism, such as a virus or bacteria or a product of such an organism, e.g., an RNA lacking the modifications characteristic of RNAs produced in the subject cell. The innate immune response protects against viral and bacterial infection by inducing the death of cells that detect exogenous nucleic acids e.g., by detection of single- or double-stranded RNA that are recognized by pattern recognition receptors such as RIG-I, protein kinase R(PKR), MDA5, or nucleic acid-recognizing Toll-like receptors, e.g., TLR3, TLR7, TLR8, and TLR9, and activating an interferon response. As used herein, the innate immune response or interferon response operates at the single cell level causing cytokine expression, cytokine release, global inhibition of protein synthesis, global destruction of cellular RNA, upregulation of major histocompatbility molecules, and/or induction of apoptotic death, induction of gene transcription of genes involved in apoptosis, anti-growth, and innate and adaptive immune cell activation. Some of the genes induced by type I IFNs include PKR, ADAR (adenosine deaminase acting on RNA), OAS (2',5'-oligoadenylate synthetase), RNase L, and Mx proteins. PKR and ADAR lead to inhibition of translation initiation and RNA editing, respectively. OAS is a dsRNA-dependent synthetase that activates the endoribonuclease RNase L to degrade ssRNA.

Accordingly, as used herein, the phrases "innate immune response signature" or "interferon response signature" genes refer to the set of genes that are expressed or up-regulated upon an interferon response of a cell, and include, but are not limited to, IFNα, IFNB1, IFIT, OAS1, PKR, RIGI, CCL5, RAP1A, CXCL10, IFIT1, CXCL11, MX1, RP11-167P23.2, HERC5, GALR3, IFIT3, IFIT2, RSAD2, CDC20, TLR3, TLR7, TLR8, and TLR9.

As used herein, the term "inhibitor of interferon expression or activity" refers to an agent (e.g., small molecule, antibody, antibody fragment, soluble receptor, RNA interference molecule etc.) that: (a) inhibits translation of an interferon polypeptide from an mRNA transcript, (b) inactivates an interferon polypeptide, (c) prevents interferon binding to its receptor or (d) binds/sequesters an interferon polypeptide e.g., for degradation.

As used herein, the term "unsupervised clustering analysis" or "unsupervised cluster analysis" refers to methods used in multivariate analysis to divide up objects into similar groups, or, in some embodiments, groups whose members are all close to one another on various dimensions being measured in the various objects. In cluster analysis, one does not start with any a priori notion of group characteristics. As used herein, "hierarchical cluster analysis" or "hierarchical clustering" refer to a general approach to unsupervised cluster analysis, in which the purpose is to group together objects or records that are "close" to one another. A key component of the analysis is repeated calculation of distance measures between objects, and between clusters once objects begin to be grouped into clusters. The outcome is typically represented graphically as a dendrogram. Hierarchical cluster analysis can be performed using any of a variety of unbiased computational methods, algorithms and software programs known to one of skill in the art that identify clusters or natural data structures from large data sets, such as, for example, gene expression data sets. Such methods include, but are not limited to, bottom-up hierarchical clustering, K-means clustering Affinity Propagation, non-Negative Matrix Factorization, spectral clustering, Self-Organizing Map (SOM) algorithms, and the like. In some embodiments of the aspects described herein, a SOM-based method for use in unsupervised hierarchical clustering analysis of cells contacted with the synthetic, modified RNAs described herein is the Automatic clustering using density-equalized SOM Ensembles (AUTOsome) method as described in A. M. Newman and J. B. Cooper (2010, Cell Stem Cell, 7:258-262) and A. M. Newman and J. B. Cooper (2010, BMC Bioinformatics 2010, 11:117), the contents of each of which are herein incorporated in their entireties by reference. After a clustering analysis of a given data set, such as a gene expression data set, appropriate class-based statistical tests like Student's t-test, ANOVA, or Gene Set Enrichment Analysis can be used to evaluate significance.

As used herein the term "comprising" or "comprises" is used in reference to compositions, methods, and respective component(s) thereof, that are essential to the invention, yet open to the inclusion of unspecified elements, whether essential or not.

As used herein the term "consisting essentially of" refers to those elements required for a given embodiment. The term permits the presence of elements that do not materially affect the basic and novel or functional characteristic(s) of that embodiment of the invention.

The term "consisting of" refers to compositions, methods, and respective components thereof as described herein, which are exclusive of any element not recited in that description of the embodiment.

BRIEF DESCRIPTION OF THE FIGURES

This patent application file contains at least one drawing executed in color. Copies of this patent or patent application publication with color drawing(s) will be provided by the Patent Office upon request and payment of the necessary fee.

FIGS. 2A-2R demonstrate that synthetic, modified RNA overcomes cellular anti-viral responses and can be used to direct and alter cell fate and developmental potential. FIGS. 2A-2D show microscopy images showing keratinocytes transfected 24 hours earlier with 400 ng/well of synthetic, unmodified (No Mods) (FIG. 2A), 5-methyl-cytosine modified (5mC) (FIG. 2B), pseudouridine modified (Psi) (FIG. 2C), or 5mC+Psi modified RNA encoding GFP (FIG. 2D). FIG. 2O shows growth kinetics of BJ fibroblasts transfected daily with unmodified, or synthetic, modified RNAs encoding a destabilized nuclear-localized GFP, and vehicle and untransfected controls for 10 days. FIGS. 2Q-2R demonstrate sustained GFP expression of synthetic, modified RNA transfected cells described in FIG. 2O at day 10 of transfection shown by fluorescence imaging with bright field overlay (FIG. 2Q), and flow cytometry (FIG. 2R). Error bars indicate s.d., n=3 for all panels.

FIGS. 3A-3F demonstrate penetrant and sustained protein expression mediated by synthetic, modified RNA transfection in diverse human cell types, and effects on cell viability and global gene expression. FIG. 3A depicts analysis of representative flow cytometry data showing penetrance of GFP expression 24-hour post-transfection of six human cell types transfected with 1000 ng of synthetic, modified RNA encoding GFP. Cell types included: human epidermal keratinocytes (HEKs), adipose-derived stem cells (ADSCs), and four different human fibroblast types (BJ, Detroit 551, MRC-5 and dH1f). Error bars show s.d. for triplicate wells. FIGS. 3B and 3D show representative expression time courses for cells transfected with synthetic, modified RNAs encoding high- and low-stability GFP variants (eGFP and d2eGFP, respectively), assayed by flow cytometry. FIG. 3C shows Annexin V staining at indicated days of BJ fibroblasts transfected daily over the course of 10 days. FIG. 3E depicts heatmap data from microarray analysis of BJ fibroblasts transfected for 10 consecutive days with synthetic, modified RNA encoding GFP, vehicle, or untransfected controls. A number of cell stress pathways are shown demonstrating that prolonged transfection with synthetic, modified-RNA does not significantly impact the molecular profile of transfected cells beyond upregulation of a limited number of interferon/NFκB genes highlighted in FIG. 3F. FIG. 3F depicts all genes upregulated greater than 2-fold in synthetic, modified RNA transfected cells versus untransfected cells (right) or vehicle transfected (left) showing induction of number of interferon/NFκB signaling genes consistent with the near but not absolute attenuation of interferon response shown in FIG. 2D.

FIG. 4A shows immunostaining for human KLF4, OCT4, and SOX2 proteins in keratinocytes 15 hours post-transfection with synthetic, modified RNA encoding KLF4, OCT4, or SOX2. FIGS. 4B-4D depicts a time course analysis showing kinetics and stability of KLF4, OCT4, and SOX2 proteins after synthetic, modified RNA transfection, as assayed by flow cytometry following intracellular staining of reach protein. FIG. 4E shows brightfield images taken during the derivation of RNA-iPS cells (RiPS) from dH1f fibroblasts showing early epitheliod morphology (day 6), small hES-like colonies (day 17), and appearance of mature iPS clones after mechanical picking and expansion (day 24). FIG. 4F depicts immunohistochemistry data showing expression of a panel of pluripotency markers in expanded RiPS clones derived from dH1f fibroblasts, Detroit 551 (D551) and MRC-5 fetal fibroblasts, BJ post-natal fibroblasts, and cells derived from a skin biopsy taken from an adult cystic fibrosis patient (CF), shown also in high magnification. BG01 hES cells and BJ1 fibroblasts are included as positive and negative controls, respectively.

FIGS. 5A-5B show an expression time course of low-stability nuclear GFP after a single transfection into keratinocytes, assessed by flow cytometry. Bright-field and GFP images taken at four different time points during a reprogramming experiment are shown. RNA-encoding the low-stability GFP analyzed in the left panel was spiked into the reprogramming cocktail (KMOSL) to visualize sustained protein expression from transfected synthetic, modified RNAs during iPS reprogramming (bottom panel, FIG. 5B). FIG. 5C shows antibody stains of independent RiPS clones derived from cells taken from an adult cystic fibrosis patient (CF cells), BJ postnatal fibroblasts, MRC-5 and Detroit 551 fetal fibroblasts, and human ES-derived dH1f fibroblasts. FIG. 5C panels show cell-surface staining for SSEA-3, SSEA-4, TRA-1-60 and TRA-1-81, and intracellular staining for OCT4 and NANOG. Control stains of BG01 hES cells, dH1f and BJ fibroblasts are shown. Additional control stains show the specificity of the secondary antibody used for the OCT4 and NANOG intracellular stains.

FIG. 6A depicts immunohistochemistry showing expression of pluripotency markers SSEA-4 and TRA-1-60 in a BJ fibroblast reprogramming experiment transfected for 16 days with 600 ng per day of a KMOSL modified RNA cocktail containing a destabilized GFP spike-in. Cultures were fixed for staining at day 18. 50,000 BJ cells were originally seeded onto feeder cells and went unpassaged throughout the course of the experiment. FIG. 6B shows quantification of TRA-1-60 colony count relative to the number of cells seeded.

FIG. 7A depicts a heatmap showing results of qRT-PCR analysis measuring the expression of pluripotency-associated genes in RiPS cell lines, parental fibroblasts and viral-derived iPS cells relative to hES cell controls. FIG. 7B depicts a heatmap showing results of OCT4 promoter methylation analysis of RiPS cell lines, parental fibroblasts, and hES cell controls. FIGS. 7C-7H demonstrate global gene expression profiles of BJ-, MRCS- and dH1F-derived RiPS cells shown in scatter plots against parental fibroblasts and hES cells with pluripotency-associated transcripts indicated. FIG. 7I depicts a dendrogram showing unsupervised hierarchical clustering of the global expression profiles for RiPS cells, parental fibroblasts, hES cells, and virus-derived iPS cells. The similarity metric for comparison between different cell lines is indicated on the height of cluster dendrogram. One of skill in the art can use these methods to determine the similarity between a RiPS cell and a human embryonic stem cell, or to determine differences between a RiPS cell and a iPS cell made by another method. This figure indicates that a RiPS cell has a higher degree of similarity to an embryonic stem cell than iPS cells derived using retroviruses, i.e., a RiPS cell has an "embryonic stem cell phenotype."

FIG. 8A shows yield and typology of blood-lineage colonies produced by directed differentiation of embryoid bodies in methylcellulose assays with RiPS clones derived from BJ, CF, D551 and MCR5 fibroblasts, and a human ES (H1) control. FIG. 8B depicts immunostaining showing expression of the lineage markers Tuj1 (neuronal, ectodermal), and alpha-fetoprotein (epithelial, endodermal) in RiPS clones from 3 independent RiPS derivations subjected to directed differentiation. FIG. 8C shows hematoxylin and eosin staining of BJ- and dH1F-RiPS-derived teratomas showing histological overview, ectoderm (pigmented epithelia (BJ), neural rosettes (dH1F)), mesoderm (cartilage and muscle, both), and endoderm (gut-like endothelium, both). For blood formation and methylcellulose assays, n=3 for each clone.

FIG. 10A shows TRA-1-60 horseradish peroxidase (HRP) staining conducted at day 18 of a BJ-RiPS derivation with modified RNAs encoding KMOSL and FIG. 10B shows frequency of TRA-1-60-positive colonies produced in the experiment relative to number of cells initially seeded. Error bars show s.d., n=6 for each condition. FIG. 10C shows TRA-181 HRP, TRA-160 immunofluorescence and Hoechst staining, and FIG. 10D shows colony frequencies for dH1f-RiPS experiments done using 4-factor (KMOS) and 5-factor (KMOSL) synthetic, modified RNA cocktails under 5% O2 or ambient oxygen culture conditions quantified at day 18. Control wells were transfected with equal doses of synthetic, modified RNA encoding GFP. FIGS. 10E-10G compare kinetics and efficiency of retroviral and synthetic, modified RNA reprogramming. Timeline of colony formation (FIG. 10E), TRA-1-60 HRP immuno-staining (FIG. 10F), and TRA-1-60 positive colony counts (FIG. 10G) of dH1f cells reprogrammed using KMOS retroviruses (MOI=5 of each) or synthetic, modified RNA KMOS cocktails (n=3 for each condition).

FIG. 11A shows a schematic of experimental design. FIG. 11B shows bright-field and immunostained images showing large, multi-nucleated, myosin heavy chain (MyHC) and myogenin positive myotubes in cells fixed three days after cessation of MYOD synthetic, modified RNA transfection. Synthetic, modified RNA encoding GFP was administered to the controls. FIG. 11C shows a penetrance of myogenic conversion relative to daily RNA dose. Black bars refer to an experiment in which cultures were plated at $10^4$ cells/cm$^2$, grey bars to cultures plated at $5\times10^3$ cells/cm$^2$. Error bars show s.d. for triplicate wells.

DETAILED DESCRIPTION

Figure 1:
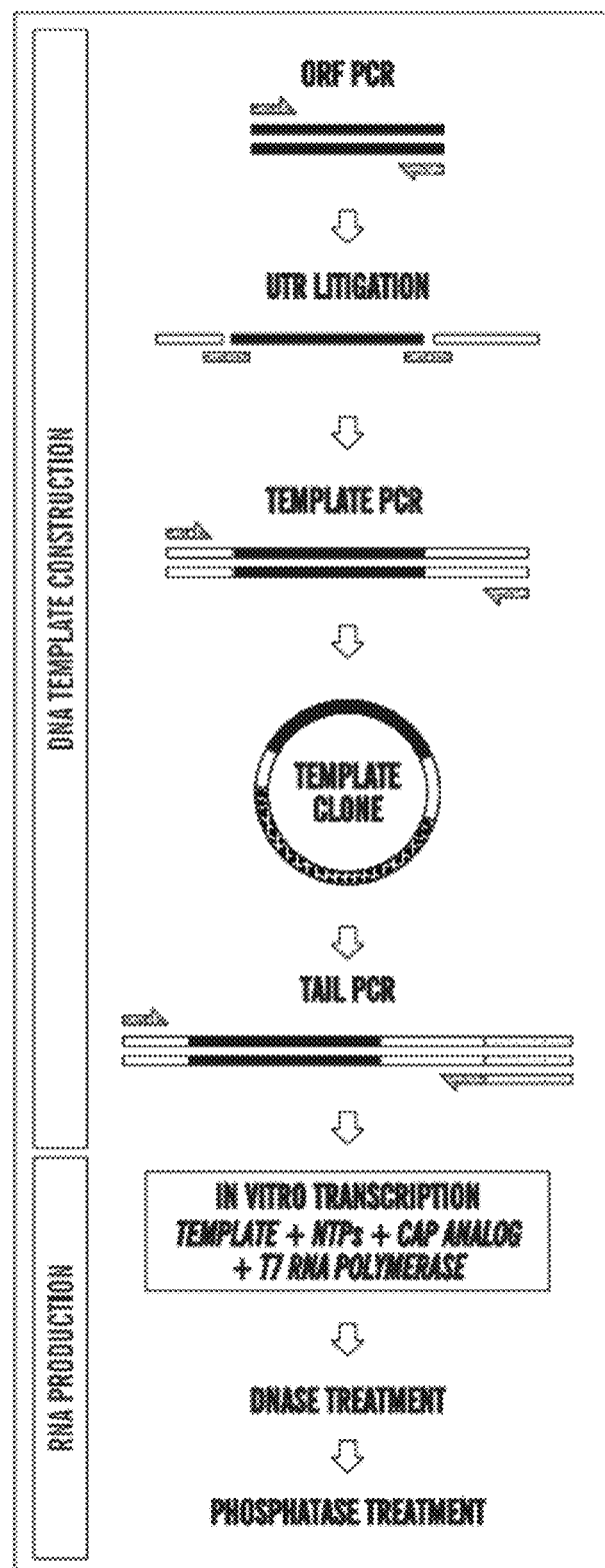
FIG. 1 depicts a synthetic, modified RNA production flowchart. To construct a template for RNA transcription reactions, the ORF of a gene of interest is first PCR amplified from a cDNA. Long oligonucleotides containing UTR sequences are then joined to the top strand of ORF amplicons by a thermostable DNA ligase, mediated by annealing to splint oligos which bring the desired single-stranded DNA (ssDNA) ends together. An upstream T7 promoter is incorporated in the 5' UTR fragment. The ssDNA product is amplified using generic primers and TA cloned. A polyA tail is added with a PCR reaction using a $T_{120}$-heeled reverse primer, and the amplicons are used to template IVT reactions. Modified and unmodified nucleobases are used in the IVT reaction. An anti-reverse di-guanosine cap analog (ARCA) is included in the IVT reaction at four-fold higher concentration than guanosine triphosphate (GTP), as a result of which an estimated 80% of the product is capped. Spin-column purified IVT product is DNase-treated to eliminate the DNA template. Treatment with a phosphatase is used to remove immunonogenic 5' triphosphate moieties from the uncapped RNA fraction. The completed synthetic, modified RNA is then re-purified for use in transfections.

Described herein are novel compositions, methods, and kits for changing the phenotype of a cell or cells. These methods, compositions, and kits can be used either to express a desired protein in a cell or tissue, or to change the developmental potential or differentiated phenotype of a cell to that of another, desired cell type. Significantly, the methods and compositions described herein do not utilize exogenous DNA or viral vector-based methods for the expression of protein(s), and thus, do not cause permanent modification of the genome or unintended mutagenic effects.

RNAs and RNA Modification

Described herein are synthetic, modified RNAs for changing the phenotype of a cell, such as expressing a polypeptide or altering the developmental potential. As used herein, the term "synthetic, modified RNA" refers to a nucleic acid molecule encoding a factor, such as a polypeptide, to be expressed in a host cell, which comprises at least one modified nucleoside and has at least the following characteristics as the term is used herein: (i) it can be generated by in vitro transcription and is not isolated from a cell; (ii) it is translatable in a mammalian (and preferably human) cell; and (iii) it does not provoke or provokes a significantly reduced innate immune response or interferon response in a cell to which it is introduced or contacted relative to a synthetic, non-modified RNA of the same sequence. A synthetic, modified RNA as described herein permits repeated transfections in a target cell; that is, a cell or cell population transfected with a synthetic, modified RNA molecule as described herein tolerates repeated transfection with such synthetic, modified RNA without significant induction of an innate immune response or interferon response. These three primary criteria for a synthetic, modified RNA molecule described above are described in greater detail below.

First, the synthetic, modified RNA must be able to be generated by in vitro transcription of a DNA template. Methods for generating templates are well known to those of skill in the art using standard molecular cloning techniques. An additional approach to the assembly of DNA templates that does not rely upon the presence of restriction endonuclease cleavage sites is also described herein (termed "splint-mediated ligation"). The transcribed, synthetic, modified RNA polymer can be modified further post-transcription, e.g., by adding a cap or other functional group.

To be suitable for in vitro transcription, the modified nucleoside(s) must be recognized as substrates by at least one RNA polymerase enzyme. Generally, RNA polymerase enzymes can tolerate a range of nucleoside base modifications, at least in part because the naturally occurring G, A, U, and C nucleoside bases differ from each other quite significantly. Thus, the structure of a modified nucleoside base for use in generating the synthetic, modified RNAs described herein can generally vary more than the sugar-phosphate moieties of the modified nucleoside. That said, ribose and phosphate-modified nucleosides or nucleoside analogs are known in the art that permit transcription by RNA polymerases. In some embodiments of the aspects described herein, the RNA polymerase is a phage RNA polymerase. The modified nucleotides pseudouridine, m5U, s2U, m6A, and m5C are known to be compatible with transcription using phage RNA polymerases, while N1-methylguanosine, N1-methyladenosine, N7-methylguanosine, 2'-)-methyluridine, and 2'-O-methylcytidine are not. Polymerases that accept modified nucleosides are known to those of skill in the art.

It is also contemplated that modified polymerases can be used to generate synthetic, modified RNAs, as described herein. Thus, for example, a polymerase that tolerates or accepts a particular modified nucleoside as a substrate can be used to generate a synthetic, modified RNA including that modified nucleoside.

Second, the synthetic, modified RNA must be translatable by the translation machinery of a eukaryotic, preferably mammalian, and more preferably, human cell. Translation generally requires at least a ribosome binding site, a methionine start codon, and an open reading frame encoding a polypeptide. Preferably, the synthetic, modified RNA also comprises a 5' cap, a stop codon, a Kozak sequence, and a polyA tail. In addition, mRNAs in a eukaryotic cell are regulated by degradation, thus a synthetic, modified RNA as described herein can be further modified to extend its half-life in the cell by incorporating modifications to reduce the rate of RNA degradation (e.g., by increasing serum stability of a synthetic, modified RNA).

Nucleoside modifications can interfere with translation. To the extent that a given modification interferes with translation, those modifications are not encompassed by the synthetic, modified RNA as described herein. One can test a synthetic, modified RNA for its ability to undergo translation and translation efficiency using an in vitro translation assay (e.g., a rabbit reticulocyte lysate assay, a reporter activity assay, or measurement of a radioactive label in the translated protein) and detecting the amount of the polypeptide produced using SDS-PAGE, Western blot, or immunochemistry assays etc. The translation of a synthetic, modified RNA comprising a candidate modification is compared to the translation of an RNA lacking the candidate modification, such that if the translation of the synthetic, modified RNA having the candidate modification remains the same or is increased then the candidate modification is contemplated for use with the compositions and methods described herein. It is noted that fluoro-modified nucleosides are generally not translatable and can be used herein as a negative control for an in vitro translation assay.

Third, the synthetic, modified RNA provokes a reduced (or absent) innate immune response or interferon response by the transfected cell or population of cells thereof. mRNA produced in eukaryotic cells, e.g., mammalian or human cells, is heavily modified, the modifications permitting the cell to detect RNA not produced by that cell. The cell responds by shutting down translation or otherwise initiating an innate immune or interferon response. Thus, to the extent that an exogenously added RNA can be modified to mimic the modifications occurring in the endogenous RNAs produced by a target cell, the exogenous RNA can avoid at least part of the target cell's defense against foreign nucleic acids. Thus, in some embodiments, synthetic, modified RNAs as described herein include in vitro transcribed RNAs including modifications as found in eukaryotic/mammalian/human RNA in vivo. Other modifications that mimic such naturally occurring modifications can also be helpful in producing a synthetic, modified RNA molecule that will be tolerated by a cell. With this as a background or threshold understanding for the requirements of a synthetic, modified RNA, the various modifications contemplated or useful in the synthetic, modified RNAs described herein are discussed further herein below.

RNA Modifications

In some aspects, provided herein are synthetic, modified RNA molecules encoding polypeptides, where the synthetic, modified RNA molecules comprise one or more modifications, such that introducing the synthetic, modified RNA molecules to a cell results in a reduced innate immune response relative to a cell contacted with synthetic RNA molecules encoding the polypeptides not comprising the one or more modifications.

The synthetic, modified RNAs described herein include modifications to prevent rapid degradation by endo- and exonucleases and to avoid or reduce the cell's innate immune or interferon response to the RNA. Modifications include, but are not limited to, for example, (a) end modifications, e.g., 5' end modifications (phosphorylation dephosphorylation, conjugation, inverted linkages, etc.), 3' end modifications (conjugation, DNA nucleotides, inverted linkages, etc.), (b) base modifications, e.g., replacement with modified bases, stabilizing bases, destabilizing bases, or bases that base pair with an expanded repertoire of partners, or conjugated bases, (c) sugar modifications (e.g., at the 2' position or 4' position) or replacement of the sugar, as well as (d) internucleoside linkage modifications, including modification or replacement of the phosphodiester linkages. To the extent that such modifications interfere with translation (i.e., results in a reduction of 50% or more in translation relative to the lack of the modification—e.g., in a rabbit reticulocyte in vitro translation assay), the modification is not suitable for the methods and compositions described herein. Specific examples of synthetic, modified RNA compositions useful with the methods described herein include, but are not limited to, RNA molecules containing modified or non-natural internucleoside linkages. Synthetic, modified RNAs having modified internucleoside linkages include, among others, those that do not have a phosphorus atom in the internucleoside linkage. In other embodiments, the synthetic, modified RNA has a phosphorus atom in its internucleoside linkage(s).

Non-limiting examples of modified internucleoside linkages include phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6, 239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, each of which is herein incorporated by reference in its entirety.

Modified internucleoside linkages that do not include a phosphorus atom therein have internucleoside linkages that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of modified oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and 5,677,439, each of which is herein incorporated by reference in its entirety.

Some embodiments of the synthetic, modified RNAs described herein include nucleic acids with phosphorothioate internucleoside linkages and oligonucleosides with heteroatom internucleoside linkage, and in particular —CH2-NH—CH2-, —CH2-N(CH3)-O—CH2- [known as a methylene (methylimino) or MMI], —CH2-O—N(CH3)-CH2-, —CH2-N(CH3)-N(CH3)-CH2- and —N(CH3)-CH2-CH2- [wherein the native phosphodiester internucleoside linkage is represented as —O—P—O—CH2-] of the above-referenced U.S. Pat. No. 5,489,677, and the amide backbones of the above-referenced U.S. Pat. No. 5,602,240, both of which are herein incorporated by reference in their entirety. In some embodiments, the nucleic acid sequences featured herein have morpholino backbone structures of the above-referenced U.S. Pat. No. 5,034,506, herein incorporated by reference in its entirety.

Synthetic, modified RNAs described herein can also contain one or more substituted sugar moieties. The nucleic acids featured herein can include one of the following at the 2' position: H (deoxyribose); OH (ribose); F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted C1 to C10 alkyl or C2 to C10 alkenyl and alkynyl. Exemplary modifications include O[(CH2)nO] mCH3, O(CH2).nOCH3, O(CH2)nNH2, O(CH2)nCH3, O(CH2)nONH2, and O(CH2)nON[(CH2)nCH3)]2, where n and m are from 1 to about 10. In some embodiments, synthetic, modified RNAs include one of the following at the 2' position: C1 to C10 lower alkyl, substituted lower alkyl, alkaryl, aralkyl, O-alkaryl or O-aralkyl, SH, SCH3, OCN, Cl, Br, CN, CF3, OCF3, SOCH3, SO2CH3, ONO2, NO2, N3, NH2, heterocycloalkyl, heterocycloalkaryl, aminoalkylamino, polyalkylamino, substituted silyl, a reporter group, an intercalator, a group for improving the pharmacokinetic properties of an RNA, or a group for improving the pharmacodynamic properties of a synthetic, modified RNA, and other substituents having similar properties. In some embodiments, the modification includes a 2' methoxyethoxy (2'-O—CH2CH2OCH3, also known as 2'-O-(2-methoxyethyl) or 2'-MOE) (Martin et al., Helv. Chim. Acta, 1995, 78:486-504) i.e., an alkoxy-alkoxy group. Another exemplary modification is 2'-dimethylaminooxyethoxy, i.e., a O(CH2)2ON (CH3)2 group, also known as 2'-DMAOE, and 2'-dimethylaminoethoxyethoxy (also known in the art as 2'-O-dimethylaminoethoxyethyl or 2'-DMAEOE), i.e., 2'-O—CH2-O—CH2-N(CH2)2.

Other modifications include 2'-methoxy (2'-OCH3), 2'-aminopropoxy (2'-OCH2CH2CH2NH2) and 2'-fluoro (2'-F). Similar modifications can also be made at other positions on the nucleic acid sequence, particularly the 3' position of the sugar on the 3' terminal nucleotide or in 2'-5' linked nucleotides and the 5' position of 5' terminal nucleotide. A synthetic, modified RNA can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference in its entirety.

As non-limiting examples, synthetic, modified RNAs described herein can include at least one modified nucleoside including a 2'-O-methyl modified nucleoside, a nucleoside comprising a 5'phosphorothioate group, a 2'-amino-modified nucleoside, 2'-alkyl-modified nucleoside, morpholino nucleoside, a phosphoramidate or a non-natural base comprising nucleoside, or any combination thereof.

In some embodiments of this aspect and all other such aspects described herein, the at least one modified nucleoside is selected from the group consisting of 5-methylcytidine (5mC), N6-methyladenosine (m6A), 3,2'-O-dimethyluridine (m4U), 2-thiouridine (s2U), 2' fluorouridine, pseudouridine, 2'-O-methyluridine (Um), 2' deoxyuridine (2' dU), 4-thiouridine (s4U), 5-methyluridine (m5U), 2'-O-methyladenosine (m6A), N6,2'-O-dimethyladenosine (m6Am), N6,N6,2'-β-trimethyladenosine (m6₂Am), 2'-O-methylcytidine (Cm), 7-methylguanosine (m7G), 2'-O-methylguanosine (Gm), N2,7-dimethylguanosine (m2,7G), N2,N2,7-trimethylguanosine (m2,2,7G), and inosine (I).

Alternatively, a synthetic, modified RNA can comprise at least two modified nucleosides, at least 3, at least 4, at least 5, at least 6, at least 7, at least 8, at least 9, at least 10, at least 15, at least 20 or more, up to the entire length of the oligonucleotide. At a minimum, a synthetic, modified RNA molecule comprising at least one modified nucleoside comprises a single nucleoside with a modification as described herein. It is not necessary for all positions in a given synthetic, modified RNA to be uniformly modified, and in fact more than one of the aforementioned modifications can be incorporated in a single synthetic, modified RNA or even at a single nucleoside within a synthetic, modified RNA. However, it is preferred, but not absolutely necessary, that each occurrence of a given nucleoside in a molecule is modified (e.g., each cytosine is a modified cytosine e.g., 5mC). However, it is also contemplated that different occurrences of the same nucleoside can be modified in a different way in a given synthetic, modified RNA molecule (e.g., some cytosines modified as 5mC, others modified as 2'-O-methylcytidine or other cytosine analog). The modifications need not be the same for each of a plurality of modified nucleosides in a synthetic, modified RNA. Furthermore, in some embodiments of the aspects described herein, a synthetic, modified RNA comprises at least two different modified nucleosides. In some such preferred embodiments of the aspects described herein, the at least two different modified nucleosides are 5-methylcytidine and pseudouridine. A synthetic, modified RNA can also contain a mixture of both modified and unmodified nucleosides.

As used herein, "unmodified" or "natural" nucleosides or nucleobases include the purine bases adenine (A) and guanine (G), and the pyrimidine bases thymine (T), cytosine (C) and uracil (U). In some embodiments, a synthetic, modified RNA comprises at least one nucleoside ("base") modification or substitution. Modified nucleosides include other synthetic and natural nucleobases such as inosine, xanthine, hypoxanthine, nubularine, isoguanisine, tubercidine, 2-(halo)adenine, 2-(alkyl)adenine, 2-(propyl)adenine, 2 (amino)adenine, 2-(aminoalkyll)adenine, 2 (aminopropyl)adenine, 2 (methylthio) N6 (isopentenyl)adenine, 6 (alkyl)adenine, 6 (methyl) adenine, 7 (deaza)adenine, 8 (alkenyl)adenine, 8-(alkyl)adenine, 8 (alkynyl)adenine, 8 (amino)adenine, 8-(halo) adenine, 8-(hydroxyl)adenine, 8 (thioalkyl)adenine, 8-(thiol) adenine, N6-(isopentyl)adenine, N6 (methyl)adenine, N6,N6 (dimethyl)adenine, 2-(alkyl)guanine, 2 (propyl)guanine, 6-(alkyl)guanine, 6 (methyl)guanine, 7 (alkyl)guanine, 7 (methyl)guanine, 7 (deaza)guanine, 8 (alkyl)guanine, 8-(alkenyl)guanine, 8 (alkynyl)guanine, 8-(amino)guanine, 8 (halo)guanine, 8-(hydroxyl)guanine, 8 (thioalkyl)guanine, 8-(thiol)guanine, N (methyl)guanine, 2-(thio)cytosine, 3 (deaza) 5 (aza)cytosine, 3-(alkyl)cytosine, 3 (methyl)cytosine, 5-(alkyl)cytosine, 5-(alkynyl)cytosine, 5 (halo)cytosine, 5 (methyl)cytosine, 5 (propynyl)cytosine, 5 (propynyl)cytosine, 5 (trifluoromethyl)cytosine, 6-(azo)cytosine, N4 (acetyl)cytosine, 3 (3 amino-3 carboxypropyl)uracil, 2-(thio)uracil, 5 (methyl) 2 (thio)uracil, 5 (methylaminomethyl)-2 (thio)uracil, 4-(thio)uracil, 5 (methyl) 4 (thio)uracil, 5 (methylaminomethyl)-4 (thio)uracil, 5 (methyl) 2,4 (dithio) uracil, 5 (methylaminomethyl)-2,4 (dithio)uracil, 5 (2-aminopropyl)uracil, 5-(alkyl)uracil, 5-(alkynyl)uracil, 5-(allylamino)uracil, 5 (aminoallyl)uracil, 5 (aminoalkyl)uracil, 5 (guanidiniumalkyl)uracil, 5 (1,3-diazole-1-alkyl)uracil, 5-(cyanoalkyl)uracil, 5-(dialkylaminoalkyl)uracil, 5 (dimethylaminoalkyl)uracil, 5-(halo)uracil, 5-(methoxy)uracil, uracil-5 oxyacetic acid, 5 (methoxycarbonylmethyl)-2-(thio) uracil, 5 (methoxycarbonyl-methyl)uracil, 5 (propynyl) uracil, 5 (propynyl)uracil, 5 (trifluoromethyl)uracil, 6 (azo) uracil, dihydrouracil, N3 (methyl)uracil, 5-uracil (i.e., pseudouracil), 2 (thio)pseudouracil,4 (thio)pseudouraci-1,2, 4-(dithio)psuedouracil,5-(alkyl)pseudouracil, 5-(methyl) pseudouracil, 5-(alkyl)-2-(thio)pseudouracil, 5-(methyl)-2-(thio)pseudouracil, 5-(alkyl)-4 (thio)pseudouracil, 5-(methyl)-4 (thio)pseudouracil, 5-(alkyl)-2,4 (dithio) pseudouracil, 5-(methyl)-2,4 (dithio)pseudouracil, 1 substituted pseudouracil, 1 substituted 2(thio)-pseudouracil, 1 substituted 4 (thio)pseudouracil, 1 substituted 2,4-(dithio) pseudouracil, 1 (aminocarbonylethylenyl)-pseudouracil, 1 (aminocarbonylethylenyl)-2(thio)-pseudouracil, 1 (aminocarbonylethylenyl)-4 (thio)pseudouracil, 1 (aminocarbonylethylenyl)-2,4-(dithio)pseudouracil, 1 (aminoalkylaminocarbonylethylenyl)-pseudouracil, 1 (aminoalkylaminocarbonylethylenyl)-2(thio)-pseudouracil, 1 (aminoalkylaminocarbonylethylenyl)-4 (thio)pseudouracil, 1 (aminoalkylaminocarbonylethylenyl)-2,4-(dithio)pseudouracil, 1,3-(diaza)-2-(oxo)-phenoxazin-1-yl, 1-(aza)-2-(thio)-3-

(aza)-phenoxazin-1-yl, 1,3-(diaza)-2-(oxo)-phenthiazin-1-yl, 1-(aza)-2-(thio)-3-(aza)-phenthiazin-1-yl, 7-substituted 1,3-(diaza)-2-(oxo)-phenoxazin-1-yl, 7-substituted 1-(aza)-2-(thio)-3-(aza)-phenoxazin-1-yl, 7-substituted 1,3-(diaza)-2-(oxo)-phenthiazin-1-yl, 7-substituted 1-(aza)-2-(thio)-3-(aza)-phenthiazin-1-yl, 7-(aminoalkylhydroxy)-1,3-(diaza)-2-(oxo)-phenoxazin-1-yl, 7-(aminoalkylhydroxy)-1-(aza)-2-(thio)-3-(aza)-phenoxazin-1-yl, 7-(aminoalkylhydroxy)-1,3-(diaza)-2-(oxo)-phenthiazin-1-yl, 7-(aminoalkylhydroxy)-1-(aza)-2-(thio)-3-(aza)-phenthiazin-1-yl, 7-(guanidiniumalkylhydroxy)-1,3-(diaza)-2-(oxo)-phenoxazin-1-yl, 7-(guanidiniumalkylhydroxy)-1-(aza)-2-(thio)-3-(aza)-phenoxazin-1-yl, 7-(guanidiniumalkyl-hydroxy)-1,3-(diaza)-2-(oxo)-phenthiazin-1-yl, 7-(guanidiniumalkylhydroxy)-1-(aza)-2-(thio)-3-(aza)-phenthiazin-1-yl, 1,3,5-(triaza)-2,6-(dioxa)-naphthalene, inosine, xanthine, hypoxanthine, nubularine, tubercidine, isoguanisine, inosinyl, 2-aza-inosinyl, 7-deaza-inosinyl, nitroimidazolyl, nitropyrazolyl, nitrobenzimidazolyl, nitroindazolyl, aminoindolyl, pyrrolopyrimidinyl, 3-(methyl)isocarbostyrilyl, 5-(methyl)isocarbostyrilyl, 3-(methyl)-7-(propynyl)isocarbostyrilyl, 7-(aza)indolyl, 6-(methyl)-7-(aza)indolyl, imidizopyridinyl, 9-(methyl)-imidizopyridinyl, pyrrolopyrizinyl, isocarbostyrilyl, 7-(propynyl)isocarbostyrilyl, propynyl-7-(aza)indolyl, 2,4,5-(trimethyl)phenyl, 4-(methyl)indolyl, 4,6-(dimethyl)indolyl, phenyl, napthalenyl, anthracenyl, phenanthracenyl, pyrenyl, stilbenzyl, tetracenyl, pentacenyl, difluorotolyl, 4-(fluoro)-6-(methyl)benzimidazole, 4-(methyl)benzimidazole, 6-(azo)thymine, 2-pyridinone, 5 nitroindole, 3 nitropyrrole, 6-(aza)pyrimidine, 2 (amino)purine, 2,6-(diamino)purine, 5 substituted pyrimidines, N2-substituted purines, N6-substituted purines, 06-substituted purines, substituted 1,2,4-triazoles, pyrrolo-pyrimidin-2-on-3-yl, 6-phenyl-pyrrolo-pyrimidin-2-on-3-yl, para-substituted-6-phenyl-pyrrolo-pyrimidin-2-on-3-yl, ortho-substituted-6-phenyl-pyrrolo-pyrimidin-2-on-3-yl, bis-ortho-substituted-6-phenyl-pyrrolo-pyrimidin-2-on-3-yl, para-(aminoalkylhydroxy)-6-phenyl-pyrrolo-pyrimidin-2-on-3-yl, ortho-(aminoalkylhydroxy)-6-phenyl-pyrrolo-pyrimidin-2-on-3-yl, bis-ortho-(aminoalkylhydroxy)-6-phenyl-pyrrolo-pyrimidin-2-on-3-yl, pyridopyrimidin-3-yl, 2-oxo-7-amino-pyridopyrimidin-3-yl, 2-oxo-pyridopyrimidine-3-yl, or any O-alkylated or N-alkylated derivatives thereof. Modified nucleosides also include natural bases that comprise conjugated moieties, e.g. a ligand. As discussed herein above, the RNA containing the modified nucleosides must be translatable in a host cell (i.e., does not prevent translation of the polypeptide encoded by the modified RNA). For example, transcripts containing s2U and m6A are translated poorly in rabbit reticulocyte lysates, while pseudouridine, m5U, and m5C are compatible with efficient translation. In addition, it is known in the art that 2'-fluoro-modified bases useful for increasing nuclease resistance of a transcript, leads to very inefficient translation. Translation can be assayed by one of ordinary skill in the art using e.g., a rabbit reticulocyte lysate translation assay.

Further modified nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in Int. Appl. No. PCT/US09/038,425, filed Mar. 26, 2009; those disclosed in The Concise Encyclopedia Of Polymer Science And Engineering, pages 858-859, Kroschwitz, J. L., ed. John Wiley & Sons, 1990, and those disclosed by Englisch et al., Angewandte Chemie, International Edition, 1991, 30, 613.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,457,191; 5,459,255; 5,484,908; 5,502,177; 5,525,711; 5,552,540; 5,587,469; 5,594,121; 5,596,091; 5,614,617; 5,681,941; 6,015,886; 6,147,200; 6,166,197; 6,222,025; 6,235,887; 6,380,368; 6,528,640; 6,639,062; 6,617,438; 7,045,610; 7,427,672; and 7,495,088, each of which is herein incorporated by reference in its entirety, and U.S. Pat. No. 5,750,692, also herein incorporated by reference in its entirety.

Another modification for use with the synthetic, modified RNAs described herein involves chemically linking to the RNA one or more ligands, moieties or conjugates that enhance the activity, cellular distribution or cellular uptake of the RNA. Ligands can be particularly useful where, for example, a synthetic, modified RNA is administered in vivo. Such moieties include but are not limited to lipid moieties such as a cholesterol moiety (Letsinger et al., Proc. Natl. Acid. Sci. USA, 1989, 86: 6553-6556, herein incorporated by reference in its entirety), cholic acid (Manoharan et al., Biorg. Med. Chem. Let., 1994, 4:1053-1060, herein incorporated by reference in its entirety), a thioether, e.g., beryl-S-tritylthiol (Manoharan et al., Ann. N.Y. Acad. Sci., 1992, 660:306-309; Manoharan et al., Biorg. Med. Chem. Let., 1993, 3:2765-2770, each of which is herein incorporated by reference in its entirety), a thiocholesterol (Oberhauser et al., Nucl. Acids Res., 1992, 20:533-538, herein incorporated by reference in its entirety), an aliphatic chain, e.g., dodecandiol or undecyl residues (Saison-Behmoaras et al., EMBO J, 1991, 10:1111-1118; Kabanov et al., FEBS Lett., 1990, 259:327-330; Svinarchuk et al., Biochimie, 1993, 75:49-54, each of which is herein incorporated by reference in its entirety), a phospholipid, e.g., di-hexadecyl-rac-glycerol or triethyl-ammonium 1,2-di-O-hexadecyl-rac-glycero-3-phosphonate (Manoharan et al., Tetrahedron Lett., 1995, 36:3651-3654; Shea et al., Nucl. Acids Res., 1990, 18:3777-3783, each of which is herein incorporated by reference in its entirety), a polyamine or a polyethylene glycol chain (Manoharan et al., Nucleosides & Nucleotides, 1995, 14:969-973, herein incorporated by reference in its entirety), or adamantane acetic acid (Manoharan et al., Tetrahedron Lett., 1995, 36:3651-3654, herein incorporated by reference in its entirety), a palmityl moiety (Mishra et al., Biochim. Biophys. Acta, 1995, 1264: 229-237, herein incorporated by reference in its entirety), or an octadecylamine or hexylamino-carbonyloxycholesterol moiety (Crooke et al., J. Pharmacol. Exp. Ther., 1996, 277: 923-937, herein incorporated by reference in its entirety).

The synthetic, modified RNAs described herein can further comprise a 5' cap. In some embodiments of the aspects described herein, the synthetic, modified RNAs comprise a 5' cap comprising a modified guanine nucleotide that is linked to the 5' end of an RNA molecule using a 5'-5' triphosphate linkage. As used herein, the term "5' cap" is also intended to encompass other 5' cap analogs including, e.g., 5' diguanosine cap, tetraphosphate cap analogs having a methylene-bis (phosphonate) moiety (see e.g., Rydzik, A M et al., (2009) Org Biomol Chem 7(22):4763-76), dinucleotide cap analogs having a phosphorothioate modification (see e.g., Kowalska, J. et al., (2008) RNA 14(6):1119-1131), cap analogs having a sulfur substitution for a non-bridging oxygen (see e.g., Grudzien-Nogalska, E. et al., (2007) RNA 13(10): 1745-1755), N7-benzylated dinucleoside tetraphosphate analogs (see e.g., Grudzien, E. et al., (2004) RNA 10(9):1479-1487), or anti-reverse cap analogs (see e.g., Jemielity, J. et al., (2003) RNA 9(9): 1108-1122 and Stepinski, J. et al., (2001) RNA 7(10):1486-1495). In one such embodiment, the 5' cap analog is a 5' diguanosine cap. In some embodiments, the synthetic, modified RNA does not comprise a 5' triphosphate.

The 5' cap is important for recognition and attachment of an mRNA to a ribosome to initiate translation. The 5' cap also protects the synthetic, modified RNA from 5' exonuclease mediated degradation. It is not an absolute requirement that a synthetic, modified RNA comprise a 5' cap, and thus in other embodiments the synthetic, modified RNAs lack a 5' cap. However, due to the longer half-life of synthetic, modified RNAs comprising a 5' cap and the increased efficiency of translation, synthetic, modified RNAs comprising a 5' cap are preferred herein.

The synthetic, modified RNAs described herein can further comprise a 5' and/or 3' untranslated region (UTR). Untranslated regions are regions of the RNA before the start codon (5') and after the stop codon (3'), and are therefore not translated by the translation machinery. Modification of an RNA molecule with one or more untranslated regions can improve the stability of an mRNA, since the untranslated regions can interfere with ribonucleases and other proteins involved in RNA degradation. In addition, modification of an RNA with a 5' and/or 3' untranslated region can enhance translational efficiency by binding proteins that alter ribosome binding to an mRNA. Modification of an RNA with a 3' UTR can be used to maintain a cytoplasmic localization of the RNA, permitting translation to occur in the cytoplasm of the cell. In one embodiment, the synthetic, modified RNAs described herein do not comprise a 5' or 3' UTR. In another embodiment, the synthetic, modified RNAs comprise either a 5' or 3' UTR. In another embodiment, the synthetic, modified RNAs described herein comprise both a 5' and a 3' UTR. In one embodiment, the 5' and/or 3' UTR is selected from an mRNA known to have high stability in the cell (e.g., a murine alpha-globin 3' UTR). In some embodiments, the 5' UTR, the 3' UTR, or both comprise one or more modified nucleosides.

In some embodiments, the synthetic, modified RNAs described herein further comprise a Kozak sequence. The "Kozak sequence" refers to a sequence on eukaryotic mRNA having the consensus (gcc)gccRccAUGG (SEQ ID NO: 1481), where R is a purine (adenine or guanine) three bases upstream of the start codon (AUG), which is followed by another 'G'. The Kozak consensus sequence is recognized by the ribosome to initiate translation of a polypeptide. Typically, initiation occurs at the first AUG codon encountered by the translation machinery that is proximal to the 5' end of the transcript. However, in some cases, this AUG codon can be bypassed in a process called leaky scanning. The presence of a Kozak sequence near the AUG codon will strengthen that codon as the initiating site of translation, such that translation of the correct polypeptide occurs. Furthermore, addition of a Kozak sequence to a synthetic, modified RNA will promote more efficient translation, even if there is no ambiguity regarding the start codon. Thus, in some embodiments, the synthetic, modified RNAs described herein further comprise a Kozak consensus sequence at the desired site for initiation of translation to produce the correct length polypeptide. In some such embodiments, the Kozak sequence comprises one or more modified nucleosides.

In some embodiments, the synthetic, modified RNAs described herein further comprise a "poly (A) tail", which refers to a 3' homopolymeric tail of adenine nucleotides, which can vary in length (e.g., at least 5 adenine nucleotides) and can be up to several hundred adenine nucleotides). The inclusion of a 3' poly(A) tail can protect the synthetic, modified RNA from degradation in the cell, and also facilitates extra-nuclear localization to enhance translation efficiency. In some embodiments, the poly(A) tail comprises between 1 and 500 adenine nucleotides; in other embodiments the poly (A) tail comprises at least 5, at least 10, at least 20, at least 30, at least 40, at least 50, at least 60, at least 70, at least 80, at least 90, at least 100, at least 110, at least 120, at least 130, at least 140, at least 150, at least 160, at least 170, at least 180, at least 190, at least 200, at least 225, at least 250, at least 275, at least 300, at least 325, at least 350, at least 375, at least 400, at least 425, at least 450, at least 475, at least 500 adenine nucleotides or more. In one embodiment, the poly(A) tail comprises between 1 and 150 adenine nucleotides. In another embodiment, the poly(A) tail comprises between 90 and 120 adenine nucleotides. In some such embodiments, the poly(A) tail comprises one or more modified nucleosides.

It is contemplated that one or more modifications to the synthetic, modified RNAs described herein permit greater stability of the synthetic, modified RNA in a cell. To the extent that such modifications permit translation and either reduce or do not exacerbate a cell's innate immune or interferon response to the synthetic, modified RNA with the modification, such modifications are specifically contemplated for use herein. Generally, the greater the stability of a synthetic, modified RNA, the more protein can be produced from that synthetic, modified RNA. Typically, the presence of AU-rich regions in mammalian mRNAs tend to destabilize transcripts, as cellular proteins are recruited to AU-rich regions to stimulate removal of the poly(A) tail of the transcript. Loss of a poly(A) tail of a synthetic, modified RNA can result in increased RNA degradation. Thus, in one embodiment, a synthetic, modified RNA as described herein does not comprise an AU-rich region. In particular, it is preferred that the 3' UTR substantially lacks AUUUA sequence elements.

In one embodiment, a ligand alters the cellular uptake, intracellular targeting or half-life of a synthetic, modified RNA into which it is incorporated. In some embodiments a ligand provides an enhanced affinity for a selected target, e.g., molecule, cell or cell type, intracellular compartment, e.g., mitochondria, cytoplasm, peroxisome, lysosome, as, e.g., compared to a composition absent such a ligand. Preferred ligands do not interfere with expression of a polypeptide from the synthetic, modified RNA.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin or hyaluronic acid); or a lipid. The ligand can also be a recombinant or synthetic molecule, such as a synthetic polymer, e.g., a synthetic polyamino acid. Examples of polyamino acids include polylysine (PLL), poly L aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell targeting agent, (e.g., a lectin, glycoprotein, lipid or protein), or an antibody, that binds to a specified cell type such as a fibroblast cell. A targeting group can be, for example, a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, or an RGD peptide or RGD peptide mimetic, among others.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid,O3-(oleoyl)lithocholic acid, O3-(oleoyl)cholenic acid, dimethoxytrityl, or phenoxazine) and peptide conjugates (e.g., antennapedia peptide, Tat peptide), alkylating agents, amino, mercapto, PEG (e.g., PEG-40K), MPEG, [MPEG]2, polyamino, alkyl, substituted alkyl, radiolabeled markers, enzymes, haptens (e.g. biotin), and transport/absorption facilitators (e.g., aspirin, vitamin E, folic acid).

Ligands can be proteins, e.g., glycoproteins, or peptides, e.g., molecules having a specific affinity for a co-ligand, or antibodies e.g., an antibody, that binds to a specified cell type such as a fibroblast cell, or other cell useful in the production of polypeptides. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose.

The ligand can be a substance, e.g., a drug, which can increase the uptake of the synthetic, modified RNA or a composition thereof into the cell, for example, by disrupting the cell's cytoskeleton, e.g., by disrupting the cell's microtubules, microfilaments, and/or intermediate filaments. The drug can be, for example, taxol, vincristine, vinblastine, cytochalasin, nocodazole, japlakinolide, latrunculin A, phalloidin, swinholide A, indanocine, or myoservin.

One exemplary ligand is a lipid or lipid-based molecule. A lipid or lipid-based ligand can (a) increase resistance to degradation, and/or (b) increase targeting or transport into a target cell or cell membrane. A lipid based ligand can be used to modulate, e.g., binding of the modified RNA composition to a target cell.

In another aspect, the ligand is a moiety, e.g., a vitamin, which is taken up by a host cell. Exemplary vitamins include vitamin A, E, and K. Other exemplary vitamins include B vitamin, e.g., folic acid, B12, riboflavin, biotin, pyridoxal or other vitamins or nutrients taken up, for example, by cancer cells. Also included are HSA and low density lipoprotein (LDL).

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

Synthesis of Synthetic, Modified RNAs

The synthetic, modified RNAs described herein can be synthesized and/or modified by methods well established in the art, such as those described in "Current Protocols in Nucleic Acid Chemistry," Beaucage, S. L. et al. (Edrs.), John Wiley & Sons, Inc., New York, N.Y., USA, which is hereby incorporated herein by reference in its entirety. Transcription methods are described further herein in the Examples.

In one embodiment of the aspects described herein, a template for a synthetic, modified RNA is synthesized using "splint-mediated ligation," which allows for the rapid synthesis of DNA constructs by controlled concatenation of long oligos and/or dsDNA PCR products and without the need to introduce restriction sites at the joining regions. It can be used to add generic untranslated regions (UTRs) to the coding sequences of genes during T7 template generation. Splint mediated ligation can also be used to add nuclear localization sequences to an open reading frame, and to make dominant-negative constructs with point mutations starting from a wild-type open reading frame. Briefly, single-stranded and/or denatured dsDNA components are annealed to splint oligos which bring the desired ends into conjunction, the ends are ligated by a thermostable DNA ligase and the desired constructs amplified by PCR. A synthetic, modified RNA is then synthesized from the template using an RNA polymerase in vitro. After synthesis of a synthetic, modified RNA is complete, the DNA template is removed from the transcription reaction prior to use with the methods described herein.

In some embodiments of these aspects, the synthetic, modified RNAs are further treated with an alkaline phosphatase.

Plurality of Synthetic, Modified RNAs

In some embodiments of the aspects described herein, a plurality of different synthetic, modified RNAs are contacted with, or introduced to, a cell, population of cells, or cell culture and permit expression of at least two polypeptide products in the cell. In some embodiments, synthetic, modified RNA compositions comprise two or more synthetic, modified RNAs, e.g., 2, 3, 4, 5, 6, 7, 8, 9, 10 or more synthetic, modified RNAs. In some embodiments, the two or more synthetic, modified RNAs are capable of increasing expression of a desired polypeptide product (e.g., a transcription factor, a cell surface marker, a death receptor, etc.).

In some embodiments, when a plurality of different synthetic, modified RNAs, synthetic, modified RNA compositions, or media comprising a plurality of different synthetic, modified RNAs are used to modulate expression of a desired set of polypeptides, the plurality of synthetic, modified RNAs can be contacted with, or introduced to, a cell, population of cells, or cell culture simultaneously. In other embodiments, the plurality of synthetic, modified RNAs can be contacted with, or introduced to, a cell, population of cells, or cell culture separately. In addition, each synthetic, modified RNA can be administered according to its own dosage regime. For example, in one embodiment, a composition can be prepared comprising a plurality of synthetic, modified RNAs, in differing relative amounts or in equal amounts, that is contacted with a cell such that the plurality of synthetic, modified RNAs are administered simultaneously. Alternatively, one synthetic, modified RNA at a time can be administered to a cell culture (e.g., sequentially). In this manner, the expression desired for each target polypeptide can be easily tailored by altering the frequency of administration and/or the amount of a particular synthetic, modified RNA administered. Contacting a cell with each synthetic, modified RNA separately can also prevent interactions between the synthetic, modified RNAs that can reduce efficiency of expression. For ease of use and to prevent potential contamination, it is preferred to administer to or contact a cell, population of cells, or cell culture with a cocktail of different synthetic, modified RNAs, thereby reducing the number of doses required and minimizing the chance of introducing a contaminant to the cell, population of cells, or cell culture.

The methods and compositions described herein permit the expression of one or more polypeptides to be tuned to a desired level by varying the amount of each synthetic, modified RNA transfected. One of skill in the art can easily monitor the expression level of the polypeptide encoded by a synthetic, modified RNA using e.g., Western blotting techniques or immunocytochemistry techniques. A synthetic, modified RNA can be administered at a frequency and dose that permit a desired level of expression of the polypeptide. Each different synthetic, modified RNA can be administered at its own dose and frequency to permit appropriate expression. In addition, since the synthetic, modified RNAs administered to the cell are transient in nature (i.e., are degraded over time) one of skill in the art can easily remove or stop expression of a synthetic, modified RNA by halting further transfections and permitting the cell to degrade the synthetic, modified RNA over time. The synthetic, modified RNAs will degrade in a manner similar to cellular mRNAs.

Introducing a Synthetic, Modified RNA into a Cell

A synthetic, modified RNA can be introduced into a cell in any manner that achieves intracellular delivery of the synthetic, modified RNA, such that expression of the polypeptide encoded by the synthetic, modified RNA can occur. As used herein, the term "transfecting a cell" refers to the process of introducing nucleic acids into cells using means for facilitating or effecting uptake or absorption into the cell, as is understood by those skilled in the art. As the term is used herein, "transfection" does not encompass viral- or viral particle based delivery methods. Absorption or uptake of a synthetic, modified RNA can occur through unaided diffusive or active cellular processes, or by auxiliary agents or devices. Further approaches are described herein below or known in the art.

A synthetic, modified RNA can be introduced into a target cell, for example, by transfection, nucleofection, lipofection, electroporation (see, e.g., Wong and Neumann, Biochem. Biophys. Res. Commun. 107:584-87 (1982)), microinjection (e.g., by direct injection of a synthetic, modified RNA), biolistics, cell fusion, and the like. In an alternative embodiment, a synthetic, modified RNA can be delivered using a drug delivery system such as a nanoparticle, a dendrimer, a polymer, a liposome, or a cationic delivery system. Positively charged cationic delivery systems facilitate binding of a synthetic, modified RNA (negatively charged polynucleotides) and also enhances interactions at the negatively charged cell membrane to permit efficient cellular uptake. Cationic lipids, dendrimers, or polymers can either be bound to modified RNAs, or induced to form a vesicle or micelle (see e.g., Kim SH., et al (2008) Journal of Controlled Release 129(2):107-116) that encases the modified RNA. Methods for making and using cationic-modified RNA complexes are well within the abilities of those skilled in the art (see e.g., Sorensen, D R., et al (2003) J. Mol. Biol. 327:761-766; Verma, U N., et al (2003) Clin. Cancer Res. 9:1291-1300; Arnold, A S et al (2007) J. Hypertens. 25:197-205, which are incorporated herein by reference in their entirety).

In some embodiments of the aspects described herein, the composition further comprises a reagent that facilitates uptake of a synthetic, modified RNA into a cell (transfection reagent), such as an emulsion, a liposome, a cationic lipid, a non-cationic lipid, an anionic lipid, a charged lipid, a penetration enhancer or alternatively, a modification to the synthetic, modified RNA to attach e.g., a ligand, peptide, lipophillic group, or targeting moiety.

The process for delivery of a synthetic, modified RNA to a cell will necessarily depend upon the specific approach for transfection chosen. One preferred approach is to add the RNA, complexed with a cationic transfection reagent (see below) directly to the cell culture media for the cells.

It is also contemplated herein that a first and second synthetic, modified RNA are administered in a separate and temporally distinct manner. Thus, each of a plurality of synthetic, modified RNAs can be administered at a separate time or at a different frequency interval to achieve the desired expression of a polypeptide. Typically, 100 fg to 100 pg of a synthetic, modified RNA is administered per cell using cationic lipid-mediated transfection. Since cationic lipid-mediated transfection is highly inefficient at delivering synthetic, modified RNAs to the cytosol, other techniques can require less RNA. The entire transcriptome of a mammalian cell constitutes about 1 pg of mRNA, and a polypeptide (e.g., a transcription factor) can have a physiological effect at an abundance of less than 1 fg per cell.

Transfection Reagents

In certain embodiments of the aspects described herein, a synthetic, modified RNA can be introduced into target cells by transfection or lipofection. Suitable agents for transfection or lipofection include, for example, calcium phosphate, DEAE dextran, lipofectin, lipofectamine, DIMRIE C™, Superfect™, and Effectin™ (Qiagen™), Unifectin™, Maxifectin™, DOTMA, DOGS™ (Transfectam; dioctadecylamidoglycylspermine), DOPE (1,2-dioleoyl-sn-glycero-3-phosphoethanolamine), DOTAP (1,2-dioleoyl-3-trimethylammonium propane), DDAB (dimethyl dioctadecylammonium bromide), DHDEAB (N,N-di-n-hexadecyl-N,N-dihydroxyethyl ammonium bromide), HDEAB (N-n-hexadecyl-N,N-dihydroxyethylammonium bromide), polybrene, poly(ethylenimine) (PEI), and the like. (See, e.g., Banerjee et al., Med. Chem. 42:4292-99 (1999); Godbey et al., Gene Ther. 6:1380-88 (1999); Kichler et al., Gene Ther. 5:855-60 (1998); Birchaa et al., J. Pharm. 183: 195-207 (1999)).

A synthetic, modified RNA can be transfected into target cells as a complex with cationic lipid carriers (e.g., Oligofectamine™) or non-cationic lipid-based carriers (e.g., Transit-TKO™, Minis Bio LLC, Madison, Wis.). Successful introduction of a modified RNA into host cells can be monitored using various known methods. For example, transient transfection can be signaled with a reporter, such as a fluorescent marker, such as Green Fluorescent Protein (GFP). Successful transfection of a modified RNA can also be determined by measuring the protein expression level of the target polypeptide by e.g., Western Blotting or immunocytochemistry.

In some embodiments of the aspects described herein, the synthetic, modified RNA is introduced into a cell using a transfection reagent. Some exemplary transfection reagents include, for example, cationic lipids, such as lipofectin (Junichi et al, U.S. Pat. No. 5,705,188), cationic glycerol derivatives, and polycationic molecules, such as polylysine (Lollo et al., PCT Application WO 97/30731). Examples of commercially available transfection reagents include, for example Lipofectamine™ (Invitrogen; Carlsbad, Calif.), Lipofectamine 2000™ (Invitrogen; Carlsbad, Calif.), 293Fectin™ (Invitrogen; Carlsbad, Calif.), Cellfectin™ (Invitrogen; Carlsbad, Calif.), DMRIE-C™ (Invitrogen; Carlsbad, Calif.), FreeStyle™ MAX (Invitrogen; Carlsbad, Calif.), Lipofectamine™ 2000 CD (Invitrogen; Carlsbad, Calif.), Lipofectamine™ (Invitrogen; Carlsbad, Calif.), RNAiMAX (Invitrogen; Carlsbad, Calif.), Oligofectamine™ (Invitrogen; Carlsbad, Calif.), Optifect™ (Invitrogen; Carlsbad, Calif.), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, Wis.), TransFast™ Transfection Reagent (Promega; Madison, Wis.), Tfx™-20 Reagent (Promega; Madison, Wis.), Tfx™50 Reagent (Promega; Madison, Wis.), DreamFect™ (OZ Biosciences; Marseille, France), EcoTransfect (OZ Biosciences; Marseille, France), TransPass$^a$ D1 Transfection Reagent (New England Biolabs; Ipswich, Mass., USA), LyoVec™/LipoGen™ (Invitrogen; San Diego, Calif., USA), PerFectin Transfection Reagent (Genlantis; San Diego, Calif., USA), NeuroPORTER Transfection Reagent (Genlantis; San Diego, Calif., USA), GenePORTER Transfection reagent (Genlantis; San Diego, Calif., USA), GenePORTER 2 Transfection reagent (Genlantis; San Diego, Calif., USA), Cytofectin Transfection Reagent (Genlantis; San Diego, Calif., USA), BaculoPORTER Transfection Reagent (Genlantis; San Diego, Calif., USA), TroganPORTER™ transfection Reagent (Genlantis; San Diego, Calif., USA), RiboFect (Bioline; Taunton, Mass., USA), PlasFect (Bioline; Taunton, Mass., USA), UniFECTOR (B-Bridge International; Mountain View, Calif., USA), SureFECTOR (B-Bridge International; Mountain View, Calif., USA), or HiFect™ (B-Bridge International, Mountain View, Calif., USA), among others.

In other embodiments, highly branched organic compounds, termed "dendrimers," can be used to bind the exogenous nucleic acid, such as the synthetic, modified RNAs described herein, and introduce it into the cell.

In other embodiments of the aspects described herein, non-chemical methods of transfection are contemplated. Such methods include, but are not limited to, electroporation (methods whereby an instrument is used to create micro-sized holes transiently in the plasma membrane of cells under an electric discharge), sono-poration (transfection via the application of sonic forces to cells), and optical transfection (methods whereby a tiny (~1 μm diameter) hole is transiently generated in the plasma membrane of a cell using a highly focused laser). In other embodiments, particle-based methods of transfections are contemplated, such as the use of a gene gun, whereby the nucleic acid is coupled to a nanoparticle of an inert solid (commonly gold) which is then "shot" directly into the target cell's nucleus; "magnetofection," which refers to a transfection method, that uses magnetic force to deliver exogenous nucleic acids coupled to magnetic nanoparticles into target cells; "impalefection," which is carried out by impaling cells by elongated nanostructures, such as carbon nanofibers or silicon nanowires which have been coupled to exogenous nucleic acids.

Other agents may be utilized to enhance the penetration of the administered nucleic acids, including glycols, such as ethylene glycol and propylene glycol, pyrrols such as 2-pyrrol, azones, and terpenes, such as limonene and menthone.

Synthetic, Modified RNA Compositions

In some embodiments of the aspects described herein, particularly embodiments involving in vivo administration of synthetic, modified RNAs or compositions thereof, the synthetic, modified RNAs described herein are formulated in conjunction with one or more penetration enhancers, surfactants and/or chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether.

The compositions described herein can be formulated into any of many possible administration forms, including a sustained release form. In some preferred embodiments of the aspects described herein, formulations comprising a plurality of different synthetic, modified RNAs are prepared by first mixing all members of a plurality of different synthetic, modified RNAs, and then complexing the mixture comprising the plurality of different synthetic, modified RNAs with a desired ligand or targeting moiety, such as a lipid. The compositions can be formulated as suspensions in aqueous, non-aqueous or mixed media. Aqueous suspensions can further contain substances which increase the viscosity of the suspension including, for example, sodium carboxymethylcellulose, sorbitol and/or dextran. The suspension can also contain stabilizers.

The compositions described herein can be prepared and formulated as emulsions for the delivery of synthetic, modified RNAs. Emulsions are typically heterogeneous systems of one liquid dispersed in another in the form of droplets usually exceeding 0.1 μm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain further components in addition to the dispersed phases, and the active drug (i.e., synthetic, modified RNA) which can be present as a solution in either the aqueous phase, oily phase or itself as a separate phase. Pharmaceutical excipients such as emulsifiers, stabilizers, dyes, and anti-oxidants can also be present in emulsions as needed. Emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

As noted above, liposomes can optionally be prepared to contain surface groups to facilitate delivery of liposomes and their contents to specific cell populations. For example, a liposome can comprise a surface groups such as antibodies or antibody fragments, small effector molecules for interacting with cell-surface receptors, antigens, and other like compounds.

Surface groups can be incorporated into the liposome by including in the liposomal lipids a lipid derivatized with the targeting molecule, or a lipid having a polar-head chemical group that can be derivatized with the targeting molecule in preformed liposomes. Alternatively, a targeting moiety can be inserted into preformed liposomes by incubating the preformed liposomes with a ligand-polymer-lipid conjugate.

A number of liposomes comprising nucleic acids are known in the art. WO 96/40062 (Thierry et al.) discloses methods for encapsulating high molecular weight nucleic acids in liposomes. U.S. Pat. No. 5,264,221 (Tagawa et al.) discloses protein-bonded liposomes and asserts that the contents of such liposomes can include an RNA molecule. U.S. Pat. No. 5,665,710 (Rahman et al.) describes certain methods of encapsulating oligodeoxynucleotides in liposomes. WO 97/04787 (Love et al.) discloses liposomes comprising RNAi molecules targeted to the raf gene. In addition, methods for preparing a liposome composition comprising a nucleic acid can be found in e.g., U.S. Pat. Nos. 6,011,020; 6,074,667; 6,110,490; 6,147,204; 6, 271, 206; 6,312,956; 6,465,188; 6,506,564; 6,750,016; and 7,112,337. Each of these approaches can provide delivery of a synthetic, modified RNA as described herein to a cell.

In some embodiments of the aspects described herein, the synthetic, modified RNA described herein can be encapsulated in a nanoparticle. Methods for nanoparticle packaging are well known in the art, and are described, for example, in Bose S, et al (Role of Nucleolin in Human Parainfluenza Virus Type 3 Infection of Human Lung Epithelial Cells. J. Virol. 78:8146. 2004); Dong Y et al. Poly(d,1-lactide-co-glycolide)/montmorillonite nanoparticles for oral delivery of anticancer drugs. Biomaterials 26:6068. 2005); Lobenberg R. et al (Improved body distribution of 14C-labelled AZT bound to nanoparticles in rats determined by radioluminography. J Drug Target 5:171.1998); Sakuma S R et al (Mucoadhesion of polystyrene nanoparticles having surface hydrophilic polymeric chains in the gastrointestinal tract. Int J Pharm 177:161. 1999); Virovic L et al. Novel delivery methods for treatment of viral hepatitis: an update. Expert Opin Drug Deliv 2:707.2005); and Zimmermann E et al, Electrolyte- and pH-stabilities of aqueous solid lipid nanoparticle (SLN) dispersions in artificial gastrointestinal media. Eur J Pharm Biopharm 52:203. 2001), the contents of which are herein incoporated in their entireties by reference.

Methods for Further Avoiding a Cell's Innate Immune or Interferon Response

Importantly, the inventors have discovered that the synthetic, modified RNAs described herein are significantly less cytotoxic when transfected into cells than their synthetic, unmodified RNA counterparts having the same nucleic acid sequence (as measured using e.g., TUNEL assay or simply monitoring cellularity after transfection), which permits repeated transfections of the cells for the duration necessary to express a polypeptide in a cell, or alter the phenotype or developmental fate of the cell. The decrease in cytotoxicity stems, in part, from the presence of modified nucleoside(s) in the RNA, which reduce or prevent the development of a cellular interferon response. In some embodiments of the aspects described herein, the cellular innate immune or interferon response comprises expression of a Type I or Type II interferon. In some embodiments of the aspects described herein, the cellular innate immune response comprises expression of one or more IFN signature genes selected from the group consisting of IFNα, IFNB1, IFIT, OAS1, PKR, RIGI, CCL5, RAP1A, CXCL10, IFIT1, CXCL11, MX1, RP11-167P23.2, HERC5, GALR3, IFIT3, IFIT2, RSAD2, and CDC20. As noted herein, such modifications for reducing or preventing the cellular innate response include, but are not limited to, 5-methylcytidine (5mC), N6-methyladenosine (m6A), 3,2'-O-dimethyluridine (m4U), 2-thiouridine (s2U), 2' fluorouridine, pseudouridine, 2'-O-methyluridine (Um), 2' deoxyuridine (2' dU), 4-thiouridine (s4U), 5-methyluridine (m5U), 2'-O-methyladenosine (m6A), N6,2'-O-dimethyladenosine (m6Am), N6,N6,2'-β-trimethyladenosine (m6₂Am), 2'-O-methylcytidine (Cm), 7-methylguanosine (m7G), 2'-O-methylguanosine (Gm), N2,7-dimethylguanosine (m2,7G), N2,N2,7-trimethylguanosine (m2,2,7G), and inosine (I). In some preferred embodiments, the modifications comprise 5-methylcytidine and pseudouridine.

However, the cells transfected with the synthetic, modified RNA compositions described herein can further be treated or used with other measures to prevent or reduce any remaining cytotoxicity caused by the transfection procedure, the synthetic, modified RNAs, or a combination thereof. The cytotoxicity of synthetic, unmodified RNAs involves a cellular innate immune response designed to recognize a foreign pathogen (e.g., virus) and to produce interferons, which in turn stimulates the activity of the protein kinase PKR, Toll-like receptors (TLRs) and RIG-1, among others, to mediate anti-viral actions. A significant part of an individual cell's innate immune response to foreign RNA is represented by the so-called "PKR response" triggered largely by double-stranded RNA. To the extent that all or part of the PKR response pathway can be activated by foreign single-stranded RNA, such as synthetic, modified RNAs described herein, the response is discussed herein below.

Double stranded RNA dependent protein kinase (PKR) is a member of a family of kinases that phosphorylates the alpha subunit of protein synthesis initiation factor, eIF-2 (eIF-2α) and plays a role in the translational down regulation of gene expression (Clemens et al. Mol. Biol. Rep. 1994; vol. 19: 210-10). Activation of PKR involves two molecules binding in tandem to double stranded RNA and then phosphorylating each other in an intramolecular event. (Wu et al. 1997, J. Biol. Chem. 272:1291-1296). PKR has been implicated in processes that rely on apoptosis as control mechanisms in vivo including antiviral activities, cell growth regulation and tumorigenesis (Donze et al. EMBO J. 1995, vol. 14: 3828-34; Lee et al. Virology 1994, vol. 199: 491-6; Jagus et al. Int. J. Biochem. Cell. Biol. 1989, vol. 9: 1576-86). Regulation of protein synthesis through activated PKR arises from the interaction of PKR with foreign RNA.

It has been shown that the PKR response can be reduced by removing the 5'-triphosphate on an RNA molecule, and that RNAs having a 5'-monophosphate, -diphosphate or -7-methyl guanosine cap do not activate PKR. Thus, in one embodiment, the synthetic, modified RNA described herein comprises a 5'-monophosphate, a 5'-diphosphate, or a 5' 7-methyl guanosine cap to escape the immune response initiated by PKR. In another embodiment, the synthetic, modified RNA as described herein is treated to remove the 5'-triphosphate using an alkaline phosphatase, e.g., calf intestinal phosphatase. Other modifications to prevent activation of the immune response mediators (e.g., PKR, TLRs, and RIG-1) are discussed in detail in Nallagatla, S R, et al., (2008) *RNA Biol* 5(3):140-144, which is herein incorporated by reference in its entirety.

TLR7 is known to recognize single stranded RNA and binds exogenous RNAs, such as viral single-stranded RNAs in endosomes. Modifications to the RNA that reduce recognition and/or signaling by TLR7 can reduce this aspect of the innate immune response to the RNA. TLR7 signals through MyD88 and can activate a type I IFN pathway as well as an NF-κB/IL-8 pathway.

In one embodiment, the innate immune response or interferon response can be further decreased in cells transfected with a synthetic, modified RNA as described herein by co-transfection of a dominant negative mutant of a protein involved in the immunity pathways, such as RIG-1, MYD88, VISA, PKR and Toll-like receptors. Alternatively, RNA interference (e.g., siRNA, shRNA, etc.) can be used to inhibit expression of RIG-1, MYD88, VISA, PKR, TRIF, TRL7, or TLR8, which will result in a lower innate immune mediated response in the cells.

Another approach to reduce the innate immune mediated response is to inhibit the effect of secreted interferon on cellular receptors, for example, by scavenging secreted interferon using a soluble interferon receptor (e.g., B18R) or a neutralizing antibody. In one embodiment, a modified RNA encoding an interferon scavenging agent (e.g., a soluble interferon receptor) can be administered to cells to further reduce the innate immune response of the cells.

In one embodiment, the cells transfected with synthetic, modified RNA as described herein can be grown with genetically-engineered feeder cells that secrete B18R or neutralizing antibodies to type-1 interferons.

Small molecules that inhibit the innate immune response in cells, such as chloroquine (a TLR signaling inhibitor) and 2-aminopurine (a PKR inhibitor), can also be administered into the culture media of cells transfected with the synthetic, modified RNAs described herein. Some non-limiting examples of commercially available TLR-signaling inhibitors include BX795, chloroquine, CLI-095, OxPAPC, polymyxin B, and rapamycin (all available for purchase from INVIVOGEN™). In addition, inhibitors of pattern recognition receptors (PRR) (which are involved in innate immunity signaling) such as 2-aminopurine, BX795, chloroquine, and H-89, can also be used in the compositions and methods described herein. Media supplementation with cell-penetrating peptides that inhibit proteins in the immunity pathways described above can also be combined with the use of synthetic, modified RNAs provided herein. Some non-limiting examples of commercially available cell-penetrating peptides include Pepin-MYD (INVIVOGEN™) or Pepinh-TRIF (INVIVOGEN™). An oligodeoxynucleotide antagonist for the Toll-like receptor signaling pathway can also be added to the cell culture media to reduce immunity signaling.

Another method for reducing the immune response of a cell transfected with the synthetic, modified RNAs described herein is to co-transfect mRNAs that encode negative regulators of innate immunity such as NLRX1. Alternatively, one can co-transfect viral proteins known to modulate host cell defenses such as NS1, NS3/4A, or A46R.

In another embodiment, a synthetic, modified RNA composition encoding inhibitors of the innate immune system can be used to avoid the innate immune response generated in the cell.

It is also contemplated herein that, in some embodiments, in a research setting one of skill in the art can avoid the innate immune response generated in the cell by using cells genetically deficient in antiviral pathways (e.g., VISA knockout cells).

Since induction of the innate immune response results in cytokine release and death of the cells in culture, one can determine the extent of activation of an innate immune or interferon response by measuring e.g., apoptosis (using e.g., a TUNEL assay), reduced growth rate, reduced cellularity, reduction in global protein production, or secretion of cytokines (e.g., type-I interferons such as IFN-alpha and IFN-beta, type II interferons, such as IFNγ), or upregulation of interferon stimulated genes or interferon signature genes (e.g., IFNα, IFNB1, IFIT, OAS1, PKR, RIGI, CCL5, RAP1A, CXCL10, IFIT1, CXCL11, MX1, RP11-167P23.2, HERC5, GALR3, IFIT3, IFIT2, RSAD2, and CDC20. The level of cytokine release or cell death in a transfected cell culture treated with one of the above measures described for further reducing the innate immune response can be compared to the level of an equivalent cell culture not treated to further reduce the innate immune response.

Cell Types

Provided herein are cells contacted with a synthetic, modified RNA molecule encoding a polypeptide, or a progeny cell of the contacted cell, where the synthetic, modified RNA molecule comprises one or more modifications, such that introducing the synthetic, modified RNA molecule to the cell results in a reduced innate immune response relative to the cell contacted with a synthetic RNA molecule encoding the polypeptide not comprising the one or more modifications. In some embodiments of these aspects, at least two nucleosides are modified. In some embodiments of the aspects described herein, the cellular innate immune or interferon response comprises expression of a Type I or Type II interferon. In some embodiments of the aspects described herein, the cellular innate immune response comprises expression of one or more IFN signature genes selected from the group consisting of IFNα, IFNB1, IFIT, OAS1, PKR, RIGI, CCL5, RAP1A, CXCL10, IFIT1, CXCL11, MX1, RP11-167P23.2, HERC5, GALR3, IFIT3, IFIT2, RSAD2, and CDC20. As described herein, such modifications for reducing or preventing the cellular innate immune response include, but are not limited to, 5-methylcytidine (5mC), N6-methyladenosine (m6A), 3,2'-O-dimethyluridine (m4U), 2-thiouridine (s2U), 2' fluorouridine, pseudouridine, 2'-O-methyluridine (Um), 2' deoxyuridine (2' dU), 4-thiouridine (s4U), 5-methyluridine (m5U), 2'-O-methyladenosine (m6A), N6,2'-O-dimethyladenosine (m6Am), N6,N6,2'-β-trimethyladenosine (m6$_2$Am), 2'-O-methylcytidine (Cm), 7-methylguanosine (m7G), 2'-O-methylguanosine (Gm), N2,7-dimethylguanosine (m2,7G), N2,N2,7-trimethylguanosine (m2,2,7G), and inosine (I). In some preferred embodiments, the modifications comprise 5-methylcytidine and pseudouridine.

Essentially any cell type can be transfected with synthetic, modified RNAs as described herein to alter the phenotype of the cell. Thus, differentiated somatic cells and stem cells, as well of cells of a cell line, can be transfected with synthetic, modified RNA as described herein. Provided herein are exemplary somatic cells, stem cells, and cell line sources useful with the methods and compositions described herein. However, the description herein is not meant to be limiting and any cell known or used in the art can be phenotypically modified by introducing one or more synthetic, modified RNAs as described herein. In embodiments relating to tissue regeneration or transplantation in a subject, the cells can be from an autologous, i.e., from the same subject, or from heterologous sources.

Somatic Cells

Essentially any primary somatic cell type can be used in the preparation of cells with an altered phenotype or altered developmental potential described herein. Some non-limiting examples of primary cells include, but are not limited to, fibroblast, epithelial, endothelial, neuronal, adipose, cardiac, skeletal muscle, immune cells, hepatic, splenic, lung, circulating blood cells, gastrointestinal, renal, bone marrow, and pancreatic cells. The cell can be a primary cell isolated from any somatic tissue including, but not limited to, brain, liver, lung, gut, stomach, intestine, fat, muscle, uterus, skin, spleen, endocrine organ, bone, etc. The term "somatic cell" further encompasses primary cells grown in culture, provided that the somatic cells are not immortalized.

Where the cell is maintained under in vitro conditions, conventional tissue culture conditions and methods can be used, and are known to those of skill in the art. Isolation and culture methods for various cells are well within the abilities of one skilled in the art.

Further, the parental cell can be from any mammalian species, with non-limiting examples including a murine, bovine, simian, porcine, equine, ovine, or human cell. In some embodiments, the cell is a human cell. In an alternate embodiment, the cell is from a non-human organism such as a non-human mammal.

Stem Cells

One of the most intriguing aspects of the technologies comprising the synthetic, modified RNAs described herein is the ability to use such synthetic, modified RNAs to both generate a stem cell from a differentiated cell, and to then direct the differentiation of the stem cell to one or more desired cell types.

Stem cells are undifferentiated cells defined by their ability at the single cell level to both self-renew and differentiate to produce progeny cells, including self-renewing progenitors, non-renewing progenitors, and terminally differentiated cells. Stem cells, depending on their level of differentiation, are also characterized by their ability to differentiate in vitro into functional cells of various cell lineages from multiple germ layers (endoderm, mesoderm and ectoderm), as well as to give rise to tissues of multiple germ layers following transplantation and to contribute substantially to most, if not all, tissues following injection into blastocysts. (See, e.g., Potten et al., Development 110: 1001 (1990); U.S. Pat. Nos. 5,750, 376, 5,851,832, 5,753,506, 5,589,376, 5,824,489, 5,654,183, 5,693,482, 5,672,499, and 5,849,553, all herein incorporated in their entireties by reference). The stem cells for use with the compositions and methods comprising synthetic, modified RNAs described herein can be naturally occurring stem cells or "induced" stem cells generated using the compositions, kits, and methods described herein, or by any method or composition known to one of skill in the art.

It is specifically noted that stem cells are useful not only for exploiting their differentiation potential to make desired cells, but also as a source for high quality iPS cells. That is, a non-pluripotent stem cell can be the starting point for the generation of high quality iPS cells by transfecting the non-pluripotent stem cell with one or more synthetic, modified RNAs encoding reprogramming factors, as described herein.

Stem cells are classified by their developmental potential as: (1) totipotent, meaning able to give rise to all embryonic and extraembryonic cell types; (2) pluripotent, meaning able to give rise to all embryonic cell types; (3) multipotent, meaning able to give rise to a subset of cell lineages, but all within a particular tissue, organ, or physiological system (for example, hematopoietic stem cells (HSC) can produce progeny that include HSC (self-renewal), blood cell restricted oligopotent progenitors and the cell types and elements (e.g., platelets) that are normal components of the blood); (4) oligopotent, meaning able to give rise to a more restricted subset of cell lineages than multipotent stem cells; and (5) unipotent, meaning able to give rise to a single cell lineage (e.g., spermatogenic stem cells).

Transfection with synthetic, modified RNAs directing the reprogramming of somatic, differentiated cells to pluripotency is specifically demonstrated herein. However, as also demonstrated herein, transfection with synthetic, modified RNAs can also be used to drive the differentiation, i.e., decrease the developmental potential of stem cells other than iPS cells, Stem cells of interest for producing cells with a desired phenotype or a reduced differentiation potential include embryonic cells of various types, exemplified by human embryonic stem (hES) cells, described by Thomson et al. (1998) Science 282:1145; embryonic stem cells from other primates, such as Rhesus stem cells (Thomson et al. (1995) Proc. Natl. Acad. Sci. USA 92:7844); marmoset stem cells (Thomson et al. (1996) Biol. Reprod. 55:254); and human embryonic germ (hEG) cells (Shambloft et al., Proc. Natl. Acad. Sci. USA 95:13726, 1998). Also of interest are lineage committed stem cells, such as hematopoietic or pancreatic stem cells. In some embodiments, the host cell transfected with synthetic, modified RNA is a multipotent stem cell or progenitor cell. Examples of multipotent cells useful in methods provided herein include, but are not limited to, murine embryonic stem (ES-D3) cells, human umbilical vein endothelial (HuVEC) cells, human umbilical artery smooth muscle (HuASMC) cells, human differentiated stem (HKB-II) cells, and human mesenchymal stem (hMSC) cells. An additional stem cell type of interest for use with the compositions and methods described herein are cancer stem cells.

Adult stem cells are generally limited to differentiating into different cell types of their tissue of origin. However, if the starting stem cells are derived from the inner cell mass of the embryo, they can generate many cell types of the body derived from all three embryonic cell types: endoderm, mesoderm and ectoderm. Stem cells with this property are said to be pluripotent. Embryonic stem cells are one kind of pluripotent stem cell. Thus, pluripotent embryonic stem cells can be differentiated into many specific cell types, and that differentiation can be driven by the expression of polypeptides from synthetic, modified RNAs as described herein. Since the embryo is a potential source of all types of precursor cells, it is possible to differentiate embryonic stem cells into other lineages by providing the appropriate signals, such as the expression of proteins from synthetic, modified RNAs, to embryonic stem cells. Somatic stem cells also have major advantages, for example, using somatic stem cells allows a patient's own cells to be expanded in culture and then re-introduced into the patient. In addition and importantly, iPS cells generated from a patient provide a source of cells that can be expanded and re-introduced to the patient, before or after stimulation to differentiate to a desired lineage or phenotype. It is also contemplated that the compositions, methods and kits comprising the synthetic, modified RNAs described can be used to alter the developmental potential of a cancer stem cell, and thus render that cancer cell non-cancerous.

Cells derived from embryonic sources can include embryonic stem cells or stem cell lines obtained from a stem cell bank or other recognized depository institution. Other means of producing stem cell lines include the method of Chung et al (2006) which comprises taking a blastomere cell from an early stage embryo prior to formation of the blastocyst (at around the 8-cell stage). The technique corresponds to the pre-implantation genetic diagnosis technique routinely practiced in assisted reproduction clinics. The single blastomere cell is then co-cultured with established ES-cell lines and then separated from them to form fully competent ES cell lines.

Cells can also be derived from human umbilical cord blood cells (HUCBC), which are recognized as a rich source of hematopoietic and mesenchymal stem cells (Broxmeyer et al., 1992 Proc. Natl. Acad. Sci. USA 89:4109-4113). Cord blood cells are used as a source of transplantable stem and progenitor cells and as a source of marrow repopulating cells for the treatment of malignant diseases (e.g. acute lymphoid leukemia, acute myeloid leukemia, chronic myeloid leukemia, myelodysplastic syndrome, and nueroblastoma) and non-malignant diseases such as Fanconi's anemia and aplastic anemia (Kohli-Kumar et al., 1993 Br. J. Haematol. 85:419-422; Wagner et al., 1992 Blood 79; 1874-1881; Lu et al., 1996 Crit. Rev. Oncol. Hematol 22:61-78; Lu et al., 1995 Cell Transplantation 4:493-503). One advantage of HUCBC for use with the methods and compositions described herein is the immature immunity of these cells, which is very similar to fetal cells, and thus significantly reduces the risk for rejection by the host (Taylor & Bryson, 1985 J. Immunol. 134:1493-1497).

In other embodiments of the aspects described herein, cancer stem cells are used with the synthetic, modified RNAs described herein, in order to, for example, differentiate or alter the phenotype of a cancer stem cell to a non-tumorigenic state. It has been recently discovered that stem-like cells are present in some human tumors and, while representing a small minority of the total cellular mass of the tumor, are the subpopulation of tumor cells responsible for growth of the tumor. In contrast to normal stem cells, "tumor stem cells" or "cancer stem cells" are defined as cells that can undergo self-renewal, as well as abnormal proliferation and differentiation to form a tumor. Functional features of tumor stem cells are that they are tumorigenic; they can give rise to additional tumorigenic cells by self-renewal; and they can give rise to non-tumorigenic tumor cells. As used herein, particularly in reference to an isolated cell or isolated cell population, the term "tumorigenic" refers to a cell derived from a tumor that is capable of forming a tumor, when dissociated and transplanted into a suitable animal model such as an immunocompromised mouse. The developmental origin of tumor stem cells can vary among different types of cancers. It is believed, without wishing to be bound or limited by theory, that tumor stem cells may arise either as a result of genetic damage that deregulates normal mechanisms of proliferation and differentiation of stem cells (Lapidot et al., Nature 367(6464): 645-8 (1994)), or by the dysregulated proliferation of populations of cells that acquire stem-like properties.

Tumors contain a distinct subset of cells that share the properties of normal stem cells, in that they proliferate extensively or indefinitely and that they efficiently give rise to additional solid tumor stem cells. Within an established tumor, most cells may have lost the ability to proliferate extensively and form new tumors, while tumor stem cells proliferate extensively and give rise to additional tumor stem cells as well as to other tumor cells that lack tumorigenic potential. An additional trait of tumor stem cells is their resistance to therapeutics, such as chemotherapy. It is the small fraction of tumor stem cells and their immediate daughter cell population that proliferates and ultimately proves fatal.

Examples of tumors from which samples containing cancer stem cells can be isolated from or enriched, for use with the compositions and methods described herein, include sarcomas and carcinomas such as, but not limited to: fibrosarcoma, myxosarcoma, liposarcoma, chondrosarcoma, osteogenic sarcoma, chordoma, angiosarcoma, endotheliosarcoma, lymphangiosarcoma, mesothelioma, Ewing's tumor, lymphangioendotheliosarcoma, synovioma, leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, testicular tumor, lung carcinoma, small cell lung carcinoma, bladder carcinoma, epithelial carcinoma, astrocytic tumors (e.g., diffuse, infiltrating gliomas, anaplastic astrocytoma, glioblastoma, gliosarcoma, pilocytic astrocytoma, pleomorphic xanthoastrocytoma), oligodendroglial tumors and mixed gliomas (e.g., oligodendroglioma, anaplastic oligodendroglioma, oligoastrocytoma, anaplastic oligoastrocytoma), ependymal tumors (e.g., ependymoma, anaplastic ependymoma, myxopapillary ependymoma, subependymoma), choroid plexus tumors, neuroepithelial tumors of uncertain origin (astroblastoma, chordoid glioma, gliomatosis cerebri), neuronal and mixed-neuronal-glial tumors (e.g., ganglioglioma and gangliocytoma, desmoplastic infantile astrocytoma and ganglioglioma, dysembryoplastic neuroepithelial tumor, central neurocytoma, cerebellar liponeurocytoma, paraganglioglioma), pineal parenchymal tumors, embryonal tumors (medulloepithelioma, ependymoblastoma, medulloblastoma, primitive neuroectodemmal tumor, atypical teratoid/rhabdoid tumor), peripheral neuroblastic tumors, tumors of cranial and peripheral nerves (e.g., schwannoma, neurinofibroma, perineurioma, malignant peripheral nerve sheath tumor), meningeal tumors (e.g., meningeomas, mesenchymal, non-meningothelial tumors, haemangiopericytomas, melanocytic lesions), germ cell tumors, tumors of the sellar region (e.g., craniopharyngioma, granular cell tumor of the neurohypophysis), hemangioblastoma, melanoma, and retinoblastoma. Additionally, the stem cell isolation methods of the invention are applicable to isolating stem cells from tissues other than characterized tumors (e.g., from tissues of diseases such as the so called "stem cell pathologies").

Stem cells may be obtained from any mammalian species, e.g. human, primate, equine, bovine, porcine, canine, feline, rodent, e.g. mice, rats, hamster, etc. Embryonic stem cells are considered to be undifferentiated when they have not committed to a specific differentiation lineage. Such cells display morphological characteristics that distinguish them from differentiated cells of embryo or adult origin. Undifferentiated embryonic stem (ES) cells are easily recognized by those skilled in the art, and typically appear in the two dimensions of a microscopic view in colonies of cells with high nuclear/cytoplasmic ratios and prominent nucleoli.

In some embodiments, the stem cell is isolated. Most conventional methods to isolate a particular stem cell of interest involve positive and negative selection using markers of interest. For example, agents can be used to recognize stem cell markers, for instance labeled antibodies that recognize and bind to cell-surface markers or antigens on desired stem cells can be used to separate and isolate the desired stem cells using fluorescent activated cell sorting (FACS), panning methods, magnetic particle selection, particle sorter selection and other methods known to persons skilled in the art, including density separation (Xu et al. (2002) Circ. Res. 91:501; U.S. patent application Ser. No. 20030022367) and separation based on other physical properties (Doevendans et al. (2000) J. Mol. Cell. Cardiol. 32:839-851).

In those embodiments involving cancer stem cells, cancer stem cells can be identified using cell surface markers that also identify normal stem cells in the tissue of origin. As a non-limiting example, leukemic stem cells (LSCs) express the CD34 surface marker and lack the CD38 surface antigen, as is the case for normal (i.e., non-leukemic) hematopoietic stem cells (Bonnet and Dick, 1997). Cancer stem cells identified by cell surface marker expression can be purified by methods known to one of skill in the art, such as fluorescence-activated cell sorting (FACS). Methods of isolating cancer stem cells can be found in United States Patent Application 20100003265, the contents of which are herein incorporated in their entirety by reference.

Alternatively, genetic selection methods for isolating stem cells can be used, where a stem cell can be genetically engineered to express a reporter protein operatively linked to a tissue-specific promoter and/or a specific gene promoter, therefore the expression of the reporter can be used for positive selection methods to isolate and enrich the desired stem cell. For example, a fluorescent reporter protein can be expressed in the desired stem cell by genetic engineering methods to operatively link the marker protein to a promoter active in a desired stem cell (Klug et al. (1996) J. Clin. Invest. 98:216-224; U.S. Pat. No. 6,737,054). Other means of positive selection include drug selection, for instance as described by Klug et al., supra, involving enrichment of desired cells by density gradient centrifugation. Negative selection can be performed, selecting and removing cells with undesired markers or characteristics, for example fibroblast markers, epithelial cell markers etc.

Undifferentiated ES cells express genes that can be used as markers to detect the presence of undifferentiated cells, and whose polypeptide products can be used as markers for negative selection. For example, see U.S. application Ser. No. 2003/0224411 A1; Bhattacharya (2004) Blood 103(8):2956-64; and Thomson (1998), supra., each herein incorporated by reference. Human ES cell lines express cell surface markers that characterize undifferentiated nonhuman primate ES and human EC cells, including stage-specific embryonic antigen (SSEA)-3, SSEA-4, TRA-1-60, TRA-1-81, and alkaline phosphatase. The globo-series glycolipid GL7, which carries the SSEA-4 epitope, is formed by the addition of sialic acid to the globo-series glycolipid Gb5, which carries the SSEA-3 epitope. Thus, GL7 reacts with antibodies to both SSEA-3 and SSEA-4. Undifferentiated human ES cell lines do not stain for SSEA-1, but differentiated cells stain strongly for SSEA-1. Methods for proliferating hES cells in the undifferentiated form are described in WO 99/20741, WO 01/51616, and WO 03/020920.

In some embodiments, the methods further provide for enrichment and isolation of stem cells. The stem cells are selected for a characteristic of interest. In some embodiments, a wide range of markers may be used for selection. One of skill in the art will be able to select markers appropriate for the desired cell type. The characteristics of interest include expression of particular markers of interest, for example specific subpopulations of stem cells and stem cell progenitors will express specific markers.

In some embodiments, the stem cells used with the compositions and methods described herein are expanded. The cells are optionally collected, separated, and further expanded generating larger populations of progenitor cells for use in making cells of a particular cell type or cells having a reduced differentiation potential.

Cell Lines

In some embodiments, the cells used with the synthetic, modified RNAs described herein are cells of a cell line. In one such embodiment, the host cell is a mammalian cell line. In one such embodiment, the mammalian cell line is a human cell line.

Examples of human cell lines useful in methods provided herein include, but are not limited to, 293T (embryonic kidney), BT-549 (breast), DMS 114 (small cell lung), DU145 (prostate), HT-1080 (fibrosarcoma), HEK 293 (embryonic kidney), HeLa (cervical carcinoma), HepG2 (hepatocellular carcinoma), HL-60(TB) (leukemia), HS 578T (breast), HT-29 (colon adenocarcinoma), Jurkat (T lymphocyte), M14 (melanoma), MCF7 (mammary), MDA-MB-453 (mammary epithelial), PERC6® (E1-transformed embryonal retina), RXF 393 (renal), SF-268 (CNS), SF-295 (CNS), THP-1

(monocyte-derived macrophages), TK-10 (renal), U293 (kidney), UACC-257 (melanoma), and XF 498 (CNS).

Examples of rodent cell lines useful in methods provided herein include, but are not limited to, mouse Sertoli (TM4) cells, mouse mammary tumor (MMT) cells, rat hepatoma (HTC) cells, mouse myeloma (NS0) cells, murine hybridoma (Sp2/0) cells, mouse thymoma (EL4) cells, Chinese Hamster Ovary (CHO) cells and CHO cell derivatives, murine embryonic (NIH/3T3, 3T3 L1) cells, rat myocardial (H9c2) cells, mouse myoblast (C2C12) cells, and mouse kidney (miMCD-3) cells.

Examples of non-human primate cell lines useful in methods provided herein include, but are not limited to, monkey kidney (CVI-76) cells, African green monkey kidney (VERO-76) cells, green monkey fibroblast (Cos-1) cells, and monkey kidney (CVI) cells transformed by SV40 (Cos-7). Additional mammalian cell lines are known to those of ordinary skill in the art and are catalogued at the American Type Culture Collection catalog (ATCC®, Mamassas, Va.).

Other Cell Types

While mammalian cells are preferred, in some embodiments, the host cell transfected with a modified RNA is a plant cell, such as a tobacco plant cell.

In some embodiments, the transfected cell is a fungal cell, such as a cell from *Pichia pastoris*, a *Rhizopus* cell, or a *Aspergillus* cell.

In some embodiments, the transfected cell is an insect cell, such as SF9 or SF-21 cells from *Spodoptera frugiperda* or S2 cells from *Drosophila melanogaster*.

Cell Culture Methods

In general, cells useful with the methods described herein can be maintained and/or expanded in a culture medium that is available to and well-known in the art. Such media include, but are not limited to, Dulbecco's Modified Eagle's Medium® (DMEM), DMEM F12 Medium®, Eagle's Minimum Essential Medium®, F-12K Medium®, Iscove's Modified Dulbecco's Medium®, RPMI-1640 Medium®, and serum-free medium for culture and expansion of progenitor cells SFEM®. Many media are also available as low-glucose formulations, with or without sodium.

Cells can be cultured in low-serum or serum-free "defined" culture medium. Serum-free medium used to culture cells is described in, for example, U.S. Pat. No. 7,015,037. Many cells have been grown in serum-free or low-serum medium. For example, the medium can be supplemented with one or more growth factors. Commonly used growth factors include, but are not limited to, bone morphogenic protein, basic fibroblast growth factor, platelet-derived growth factor and epidermal growth factor, Stem cell factor, and thrombopoietin. See, for example, U.S. Pat. Nos. 7,169,610; 7,109,032; 7,037,721; 6,617,161; 6,617,159; 6,372,210; 6,224,860; 6,037,174; 5,908,782; 5,766,951; 5,397,706; and 4,657,866; all incorporated by reference herein for teaching growing cells in serum-free medium.

Cells in culture can be maintained either in suspension or attached to a solid support, such as extracellular matrix components. Progenitor cells may require additional factors that encourage their attachment to a solid support, such as type I and type II collagen, chondroitin sulfate, fibronectin, "superfibronectin" and fibronectin-like polymers, gelatin, poly-D and poly-L-lysine, thrombospondin and vitronectin. Progenitor cells can also be cultured in low attachment flasks such as but not limited to Corning Low attachment plates.

In some embodiments, the host cells are suitable for growth in suspension cultures. Suspension-competent host cells are generally monodisperse or grow in loose aggregates without substantial aggregation. Suspension-competent host cells include cells that are suitable for suspension culture without adaptation or manipulation (e.g., hematopoietic cells, lymphoid cells) and cells that have been made suspension-competent by modification or adaptation of attachment-dependent cells (e.g., epithelial cells, fibroblasts).

In some embodiments, the host cell is an attachment dependent cell which is grown and maintained in adherent culture.

Altering Cellular Phenotypes and Developmental Potentials

The compositions and methods comprising the synthetic, modified RNAs described herein permit long-term, safe, and efficient alteration of cellular phenotypes or cellular developmental potentials, without the risk of permanent genomic alterations. Such compositions and methods are useful for a variety of applications, indications, and modalities, including, but not limited to, gene therapy, regenerative medicine, cancer therapies, tissue engineering, and drug screening.

Accordingly, provided herein are cells contacted with a synthetic, modified RNA molecule encoding a polypeptide, or a progeny cell of the contacted cell, where expression of the encoded polypeptide in the contacted cell alters a function or a developmental phenotype or developmental potential of the cell, and results in a reduced innate immune response relative to the cell contacted with a synthetic RNA molecule encoding the polypeptide not comprising any modifications. In some embodiments, the developmental potential of the contacted cell is decreased. In some embodiments, the developmental potential of the contacted cell is increased. As such, the polypeptide encoded by the synthetic, modified RNA molecule can be a reprogramming factor, a differentiation factor, or a de-differentiation factor.

Also provided herein are cells comprising an exogenously introduced modified, synthetic RNA encoding a developmental potential altering factor. In some embodiments, the cell is a human cell. In some embodiments of these aspects, the cells or immediate precursor cell(s) have been subjected to at least 3 separate rounds of contacting with the modified, synthetic RNA encoding the developmental potential altering factor. In some such embodiments, the cells have a reduced expression of a Type I or Type II IFN relative to a cell subjected to at least 3 separate rounds of contacting with an exogenously introduced non-modified synthetic RNA encoding the developmental potential altering factor. In some such embodiments, the cell has a reduced expression of at least one IFN-signature gene relative to a human cell subjected to at least 3 separate rounds of contacting with an exogenously introduced non-modified synthetic RNA encoding the developmental potential altering factor. As described herein, the IFN-signature gene can be selected from the group consisting of IFNα, IFNB1, IFIT, OAS1, PKR, RIGI, CCL5, RAP1A, CXCL10, IFIT1, CXCL11, MX1, RP11-167P23.2, HERC5, GALR3, IFIT3, IFIT2, RSAD2, and CDC20. The polypeptide encoded by the exogenous synthetic, modified RNA molecule can be a reprogramming factor, a differentiation factor, or a de-differentiation factor. The cell or its immediate precursor cell(s) can be derived from a somatic cell, a partially reprogrammed somatic cell, a pluripotent cell, a multipotent cell, a differentiated cell, or an embryonic cell.

As used herein, the term "developmental potential of a cell" refers to the total of all developmental cell fates or cell types that can be achieved by a cell upon differentiation. It should be understood that the developmental potential of a cell represents a spectrum: a terminally differentiated cell, e.g., a cardiac myocyte, has essentially no developmental potential under natural conditions—that is, under normal circumstances, it cannot differentiate to another cell type; while at the other end of the spectrum, a totipotent embryonic stem cell has the potential to differentiate to or give rise to cells of every type in an organism, as well as the extra-embryonic structures. A cell with "parental developmental potential" refers to a cell having the developmental potential of the parent cell that gave rise to it.

The term "developmental potential of a cell" is relative. For example, where a stem cell undergoes differentiation to a more differentiated or specialized phenotype, the resulting cell has a reduced developmental potential relative to the stem cell that produced it. Unless specifically stated otherwise, the developmental potential of a cell is the potential it has assuming no further manipulation of its potential—that is, while it is acknowledged that the technology is available (as described herein) to artificially increase, decrease or otherwise alter the developmental potential of nearly any cell, to say that a cell has "reduced developmental potential" means that, without further artificial manipulation to force the cell to a less differentiated phenotype, the cell can give rise to at least one fewer cell types than its immediate predecessor cell. That is, the cell resulting from a differentiation event has a reduced developmental potential despite the fact that it could possibly be manipulated to again become less differentiated. Thus, a cell with greater or higher developmental potential can differentiate into a greater variety of different cell types than a cell having a lower or decreased developmental potential.

Where, for example, a terminally- or only partially-differentiated cell is induced by artificial manipulation to become an induced pluripotent stem cell (an iPS cell), the resulting cell has increased developmental potential relative to the cell that produced it. As used herein, a "change" or "alteration" in the developmental potential of a cell occurs when the range of phenotypes to which a given cell can differentiate or give rise increases or decreases relative to the range naturally available to the cell prior to a differentiation, dedifferentiation or transdifferentiation event. By "increase" in this context is meant that there is at least additional one cell type or lineage to which a given cell can differentiate relative to the potential of the starting cell. By "decrease" in this context is meant that there is at least one fewer cell type or lineage to which the given cell can differentiate or give rise, relative to the potential of the starting cell.

Methods of manipulating the developmental potential of a cell, both to increase the potential and to decrease it, are described herein and others are known in the art. A "change" or "alteration" in the developmental potential of a cell can occur naturally, where, for example, a cell differentiates to a more specialized phenotype in its native environment in vivo. In various preferred aspects described herein, developmental potential or cell fate are directed by outside manipulation, and preferably by transfection with synthetic, modified RNA, as that term is defined herein. Thus, in one aspect, cells are contacted or transfected with synthetic, modified RNAs encoding one or more factors that re-direct or modify the phenotype of the cells.

Synthetic, modified RNAs as described herein can be made that direct the expression of essentially any gene product whose coding sequences can be cloned. The expression of the gene product from synthetic, modified RNA introduced to a cell that does not normally express that gene product necessarily results in a change in the phenotype of the cell whether or not it changes the differentiation status or differentiation potential of the cell. Simply put, the new phenotype is the cell's expression of the new gene product. Thus, in one aspect, encompassed herein is the expression of a protein from a synthetic, modified RNA introduced to a cell. Expression that does not necessarily change the differentiation status of the cell can nonetheless be useful in such embodiments, for example, where one wishes to correct or replace a defective function in a cell, due to a genetic defect or polymorphism, or in embodiments to target a cell to a particular location, e.g., by expressing a receptor or where one wishes to induce cell death in e.g., a tumor by expressing a death receptor, a death ligand, a cell cycle inhibitor etc.

In other aspects, the synthetic, modified RNAs described herein are well suited for directing the expression of any gene sequence, but are particularly well suited for modifying the differentiation status or the developmental potential of a cell, and for doing so without permanent change to the genome of the cell. This is true in part because reprogramming, differentiation and transdifferentiation each require relatively prolonged expression of one or more polypeptide factors in a target cell. Non-modified RNA is recognized as foreign by the cell's innate immune defenses against viral and bacterial RNA. If the cell transfected with non-modified RNA is not induced to undergo apoptosis or to otherwise shut down protein synthesis by a first transfection event, it will likely do so upon a subsequent transfection event with unmodified RNA.

Reprogramming

The production of cells having an increased developmental potential (e.g., iPS cells) is generally achieved by the introduction of nucleic acid sequences, specifically DNA, encoding stem cell-associated genes into an adult, somatic cell. Historically, these nucleic acids have been introduced using viral vectors and the expression of the gene products results in cells that are morphologically, biochemically, and functionally similar to pluripotent stem cells (e.g., embryonic stem cells). This process of altering a cell phenotype from a somatic cell phenotype to a pluripotent stem cell phenotype is termed "reprogramming." In the reprogramming methods described herein, the reprogramming is achieved by repeated transfection with synthetic, modified RNAs encoding the necessary reprogramming factors. The repeated transfection provides prolonged expression of the factors encoded by the synthetic, modified RNAs necessary to shift the developmental potential of the cell.

Accordingly, provided herein are pluripotent cells that are not embryonic stem cells, and which were not induced by viral expression of one or more reprogramming factors, and which when subjected to an unsupervised hierarchical cluster analysis, cluster more closely to embryonic stem cells than do pluripotent cells induced by viral expression of one or more reprogramming factors, exogenous protein introduction of one or more reprogramming factors, small molecule mediated expression or induction of one or more reprogramming factors, or any combination thereof. In some aspects, provided herein are pluripotent cells that are not embryonic stem cells, and which were not induced by viral expression of one or more reprogramming factors. In such aspects, the pluripotent cell subjected to an unsupervised hierarchical cluster analysis clusters more closely to a human embryonic stem cell than does a pluripotent cell induced by viral expression of one or more reprogramming factors. The pluripotent cell is generated from a precursor somatic cell, such as a precursor human somatic cell. The pluripotent cell or its immediate precursor cell(s) can also be derived from a somatic cell, partially reprogrammed somatic cell, a pluripotent cell, a multipotent cell, a differentiated cell, or an embryonic cell.

Reprogramming to generate pluripotent cells, as described herein, can be achieved by introducing a one or more synthetic, modified RNAs encoding stem cell-associated genes including, for example Oct-4 (also known as Oct-3/4 or Pouf51) (SEQ ID NO: 788), Sox1, Sox2 (SEQ ID NO: 941 or SEQ ID NO: 1501), Sox3, Sox 15, Sox 18, NANOG, Klf1, Klf2, Klf4 (SEQ ID NO: 501), Klf5, NR5A2, c-Myc (SEQ ID NO: 636), 1-Myc, n-Myc, Rem2, Tert, LIN28 (SEQ ID NO:

524), and Sall4. Accordingly, in some embodiments, the reprogramming factor is selected from the group consisting of: OCT4, SOX1, SOX 2, SOX 3, SOX15, SOX 18, NANOG, KLF1, KLF 2, KLF 4, KLF 5, NR5A2, c-MYC, 1-MYC, n-MYC, REM2, TERT, and LIN28. In general, successful reprogramming is accomplished by introducing at least Oct-4, a member of the Sox family, a member of the Klf family, and a member of the Myc family to a somatic cell. In some embodiments, LIN28 is also introduced. The generation of iPS cells using transfection of the synthetic, modified RNAs described herein, also referred to herein as "RiPS," from a variety of starting cell types, including an adult somatic cell, is demonstrated in the Examples herein. The generation of reprogrammed cells using the compositions and methods described herein preferably causes the induction of endogenous stem-cell associated genes, such as SOX2, REX1, DNMT3B, TRA-1-60, TRA-1-81, SSEA3, SSEA4, OCT4, and NANOG. In some embodiments, at least two endogenous stem-cell-associated genes are induced. Preferably, the endogenous expression is at a level comparable to an embryonic stem cell, such as an embryonic stem cell cultured within the same laboratory.

The methods to reprogram cells using the synthetic, modified RNAs described herein can involve repeated contacting of the cells, such as somatic cells, in order to permit sufficient expression of the encoded reprogramming factors to maintain a stable change in the developmental potential of the cells, or progeny cells thereof, being contacted. Such methods can involve repeated transfections, such as for example, at least two, at least five, at least 6, at least 7, at least 8, at least 9, at least 10, at least 11, at least 12, at least 13, at least 14, at least 15, at least 16, at least 17, at least 18, at least 19, at least 20, at least 25, at least 30, or more transfections. In other words, the methods comprise repeating transfection using the synthetic, modified RNAs until a desired phenotype of the cell or population of cells is achieved. In some embodiments, the methods further comprise contacting with or introducing the reprogramming factors to the cells under low-oxygen conditions.

The efficiency of reprogramming (i.e., the number of reprogrammed cells) can be enhanced by the addition of various small molecules as shown by Shi, Y., et al (2008) *Cell-Stem Cell* 2:525-528, Huangfu, D., et al (2008) *Nature Biotechnology* 26(7):795-797, and Marson, A., et al (2008) *Cell-Stem Cell* 3:132-135, which are incorporated herein by reference in their entirety. It is contemplated that the methods described herein can also be used in combination with a single small molecule (or a combination of small molecules) that enhances the efficiency of induced pluripotent stem cell production or replaces one or more reprogramming factors during the reprogramming process. Some non-limiting examples of agents that enhance reprogramming efficiency include soluble Wnt, Wnt conditioned media, BIX-01294 (a G9a histone methyltransferase), PD0325901 (a MEK inhibitor), DNA methyltransferase inhibitors, histone deacetylase (HDAC) inhibitors, valproic acid, 5'-azacytidine, dexamethasone, suberoylanilide, hydroxamic acid (SAHA), and trichostatin (TSA), among others.

In some embodiments of the aspects described herein, an inhibitor of p53 can be used to reduce the stress response during a reprogramming regimen to direct the cell fate away from an apoptotic stimulus and towards reprogramming. Thus, treatment with a p53 inhibitor can enhance reprogramming in a population of cells. In one such embodiment, the inhibitor of p53 comprises an siRNA directed against p53 that is administered or expressed in the reprogramming cell. In another embodiment, a small molecule inhibitor of p53 (e.g., pifithrin-α) is administered to cells during the reprogramming process. In one embodiment, a modified RNA encoding Bcl2 is administered to the cells prior to, or in conjunction with, a modified RNA composition encoding at least one reprogramming factor to prevent apoptosis of cells during the process of reprogramming.

To confirm the induction of pluripotent stem cells, isolated clones can be tested for the expression of an endogenous stem cell marker. Such expression identifies the cells as induced pluripotent stem cells. Stem cell markers can be selected from the non-limiting group including SSEA1, CD9, Nanog, Fbx15, Ecat1, Esg1, Eras, Gdf3, Fgf4, Cripto, Dax1, Zpf296, S1c2a3, Rex1, Utf1, and Nat1. Methods for detecting the expression of such markers can include, for example, RT-PCR and immunological methods that detect the presence of the encoded polypeptides. Further evidence of reprogramming is shown by a reduction in or the loss of lamin A/C protein expression. Alternatively, reprogramming is detected by measuring an increase in acetylation, such as increased acetylation of H3 and H4 within the promoter of Oct4, or by measuring a decrease in methylation, for example, by measuring the demethylation of lysine 9 of histone 3. In each of these cases, reprogramming is measured relative to a control cell. In other embodiments, reprogramming is assayed by any other method that detects chromatin remodeling leading to the activation of an embryonic stem cell marker, such as Oct4.

The pluripotent stem cell character of the isolated cells can be confirmed by any of a number of tests evaluating the expression of ES markers and the ability to differentiate to cells of each of the three germ layers. As one example, teratoma formation in nude mice can be used to evaluate the pluripotent character of the isolated clones. The cells are introduced to nude mice and histology and/or immunohistochemistry is performed on a tumor arising from the cells. The growth of a tumor comprising cells from all three germ layers further indicates that the cells are pluripotent stem cells.

The pluripotent cells generated using the compositions and methods comprising the synthetic, modified RNAs described herein cluster more closely to a human embryonic stem cell than do pluripotent cells induced by viral expression of one or more reprogramming factors, when subjected to an unsupervised hierarchical analysis, i.e., the pluripotent cells have a phenotype closer to a embryonic stem cell phenotype than do pluripotent cells induced by viral expression of one or more reprogramming factors. In some embodiments, the unsupervised hierarchical cluster analysis is performed using a Euclidean distance with average linkage method in which the similarity metric for comparison between different cells is indicated on the height of cluster dendrogram. The unsupervised hierarchical cluster analysis can be performed on any data set available to a skilled artisan, such as gene expression data, protein expression data, DNA methylation data, histone modification data, and microRNA data.

Clustering, including, "unsupervised clustering analysis" or "unsupervised cluster analysis" refers to methods used in multivariate analysis to divide up objects into similar groups, or, in some embodiments, groups whose members are all close to one another on various dimensions being measured in the various objects. A key component of the analysis is repeated calculation of distance measures between objects, and between clusters once objects begin to be grouped into clusters. The outcome is typically represented graphically as a dendrogram. Hierarchical cluster analysis can be performed using any of a variety of unbiased computational methods, algorithms and software programs known to one of skill in the art that identify clusters or natural data structures from large data sets, such as, for example, gene expression data sets. Such methods include, but are not limited to, bottom-up hierarchical clustering, K-means clustering Affinity Propagation, non-Negative Matrix Factorization, spectral clustering, Self-Organizing Map (SOM) algorithms, and the like. In some embodiments of the aspects described herein, one SOM-based method for use in unsupervised hierarchical clustering analysis of cells contacted with the synthetic, modified RNAs described herein is the Automatic clustering using density-equalized SOM Ensembles (AUTOsome) method as described in A. M. Newman and J. B. Cooper (2010, Cell Stem Cell, 7:258-262) and A. M. Newman and J. B. Cooper (2010, BMC Bioinformatics 2010, 11:117), the contents of each of which are herein incorporated in their entireties by reference.

Accordingly, also provided herein are compositions for generating such pluripotent cells, comprising at least one synthetic, modified RNA encoding a reprogramming factor, and cell growth media. The synthetic, modified RNAs can comprise any modification for reducing the innate immune response, as described herein, such as a 5' cap, a poly(A) tail, a Kozak sequence, a 3' untranslated region, a 5' untranslated region, or any combination thereof. In preferred embodiments, the synthetic, modified RNAs comprise at least two nucleoside modifications, preferably 5-methylcytidine (5mC) and pseudouridine.

In some embodiments, the compositions permit an efficiency of pluripotent cell generation from a starting population of cells, such as somatic cells, of at least 1%. In some embodiments, the efficiency of pluripotent cell generation is at least 1.1%, at least 1.2%, at least 1.3%, at least 1.4%, at least 1.5%, at least 1.6%, at least 1.7%, at least 1.8%, at least 1.9%, at least 2.0%, at least 2.1%, at least 2.2%, at least 2.3%, at least 2.4%, at least 2.5%, at least 2.6%, at least 2.7%, at least 2.8%, at least 2.9%, at least 3.0%, at least 3.1%, at least 3.2%, at least 3.3%, at least 3.4%, at least 3.5%, at least 3.6%, at least 3.7%, at least 3.8%, at least 3.9%, at least 4.0%, at least 4.1%, at least 4.2%, at least 4.3%, at least 4.4%, at least 4.5%, at least 4.6%, at least 4.7%, at least 4.8%, at least 4.9%, at least 5.0%, 5.1%, at least 5.2%, at least 5.3%, at least 5.4%, at least 5.5%, at least 5.6%, at least 5.7%, at least 5.8%, at least 5.9%, at least 6.0%, 6.1%, at least 6.2%, at least 6.3%, at least 6.4%, at least 6.5%, at least 6.6%, at least 6.7%, at least 6.8%, at least 6.9%, at least 7.0%, 7.1%, at least 8.2%, at least 8.3%, at least 8.4%, at least 8.5%, at least 8.6%, at least 8.7%, at least 8.8%, at least 8.9%, at least 9.0%, 9.1%, at least 9.2%, at least 9.3%, at least 9.4%, at least 9.5%, at least 1.6%, at least 9.7%, at least 9.8%, at least 9.9%, at least 10.0%, or more.

In some embodiments, the compositions permit a rate of pluripotent cell generation from a starting population of cells, such as somatic cells of less than 25 days, less than 24 days, less than 23 days, less than 22 days, less than 21 days, 20 days, less than 19 days, less than 18 days, less than 17 days, less than 16 days, less than 15 days, less than 14 days, and greater than 7 days.

The reprogramming factor(s) for use in the compositions, methods, and kits for reprogramming cells described herein is selected from the group consisting of: OCT4 (SEQ ID NO: 788), SOX1, SOX 2 (SEQ ID NO: 941 or SEQ ID NO: 1501), SOX 3, SOX15, SOX 18, NANOG, KLF1, KLF 2, KLF 4 (SEQ ID NO: 501), KLF 5, NR5A2, c-MYC (SEQ ID NO: 636), 1-MYC, n-MYC, REM2, TERT, and LIN28 (SEQ ID NO: 524). In some embodiments, the compositions comprise at least 4 synthetic, modified RNAs encoding at least 4 different reprogramming factors. In some such embodiments, the at least 4 different reprogramming factors encoded by the at least 4 modified synthetic RNAs comprise OCT4, SOX2, KLF4, and c-MYC. The compositions can further comprise a modified synthetic RNA encoding a LIN28 reprogramming factor. In some embodiments, the composition does not comprise a modified, synthetic RNA encoding the reprogramming factor c-MYC.

Transdifferentiation

Transdifferentiation refers to a process by which the phenotype of a cell can be switched to that of another cell type, without the formation of a pluripotent intermediate cell. Thus, the methods do not require that the cell first be de-differentiated (or reprogrammed) and then differentiated to another cell type; rather the cell type is merely "switched" from one cell type to another without first forming a less differentiated phenotype. Thus, "transdifferentiation" refers to the capacity of differentiated cells of one type to lose identifying characteristics and to change their phenotype to that of other fully differentiated cells.

Transdifferentiation can be achieved by introducing into a cell a synthetic, modified RNA composition that permits expression of a cell-type specific differentiation factor. For example, to transdifferentiate a cell to a myogenic lineage one can express MyoD using a modified RNA as described herein. While the introduction of a single differentiation factor can be enough to transdifferentiate a cell, it is also contemplated herein that a plurality of different differentiation factors are introduced to the cell during the transdifferentiation regime. Alternatively, synthetic, modified RNAs that inhibit expression of cell-type specific polypeptides of the original cell-type can also be introduced to the cell, in effect "turning off" the original phenotype of the cell. In one embodiment, modified RNAs that express a desired cell-type specific polypeptide to turn on a desired phenotype are used in combination with modified RNA interference molecules used to turn off the existing cell phenotype, in order to cause transdifferentiation of the cell from one phenotype to another.

Transdifferentiation can be useful in tissue engineering at e.g., an injury or disease site. In one embodiment, transdifferentiation is performed in vivo at the site of injury or disease. In another embodiment, an organ or tissue can be transdifferentiated/regenerated in vitro, and then introduced back into the body.

Differentiation

Differentiation is the process by which an unspecialized ("uncommitted") or less specialized cell acquires the features of a specialized cell (e.g., a terminally differentiated cell) such as, for example, a cardiomyocyte, a nerve cell or a skeletal muscle cell. A differentiated or differentiation-induced cell is one that has taken on a more specialized ("committed") position within the lineage of a cell (e.g., reduced differentiation potential). The term "committed", when applied to the process of differentiation, refers to a cell that has proceeded in the differentiation pathway to a point where, under normal circumstances, it will continue to differentiate into a specific cell type or subset of cell types, and cannot, under normal circumstances, differentiate into a different cell type or revert to a less differentiated cell type. De-differentiation refers to the process by which a cell reverts to a less specialized (or committed) position within the lineage of a cell (i.e., increased developmental potential). As used herein, the lineage of a cell defines the heredity or fate of the cell, i.e., which cells it came from and what cells it can give rise to. The lineage of a cell places the cell within a hereditary scheme of development and differentiation. A lineage-specific marker refers to a characteristic specifically associated with the phenotype of cells of a lineage of interest and can be used to assess the differentiation of an uncommitted cell to the lineage of interest.

Cells that are differentiated using the compositions and methods comprising synthetic, modified RNAs, as described herein, can be differentiated into any cell type or lineage known to one of skill in the art. Such cells can be of a lineage selected from an ecotodermal lineage, a mesodermal lineage, or an endodermal lineage. Exemplary ectodermal lineage cells include, but are not limited to, cells of the epidermis (skin cells, melanocytes), and cells of the neuronal lineage. Exemplary mesodermal lineage cells include, but are not limited to, cells of the circulatory system (cardiac cells and blood vessel cells), cells of the connective tissue, bone cells, dermal cells, myocytes (smooth and skeletal), certain cells of the urinary system, such as kidney cells, splenic cells, mesothelial cells (cells of the peritoneum, pleura, and pericardium), non-germ cells of the reproductive system, and hematopoietic lineage cells. Exemplary endodermal lineage cells include, but are not limited to, cells of the gastrointestinal system, cells of the respiratory tract, cells of the endocrine glands, cells of the auditory system, and certain cells of the urinary system, such as the bladder and parts of the urethra.

Accordingly, compositions and methods described herein include a method for programming or directing the differentiation of cells (e.g., stem cells) comprising contacting the cells desired to be differentiated with a synthetic, modified RNA or synthetic, modified RNA composition. The cells can be transfected a plurality of times until the desired differentiated phenotype is achieved, as measured by e.g., a gene expression array of cell-type specific markers, Western blotting, cell function assays etc. A selection compound may be added to the mixture, but is not required.

Typically, the synthetic, modified RNA composition transfected into the cells to promote their differentiation encodes a cell-type specific differentiation factor or factors. For example, to differentiate a cell to a neuronal cell phenotype, a synthetic, modified RNA encoding at least one neuronal differentiation factor, for example Ascl1, Brn2, Myt1l, or a combination thereof is transfected into the cell. To promote differentiation to a myogenic phenotype, a synthetic, modified RNA such as one encoding MyoD can be transfected into a cell. To differentiate a cell to a macrophage phenotype, a macrophage factor such as e.g., CEBP-alpha or PU.1 is transfected into the cell. In one embodiment, a modified RNA that encodes Ngn3, Pdx1, MAFA, or any combination thereof can be used to differentiate cells to a pancreatic beta cell phenotype. A synthetic, modified RNA encoding PRDM16 can be applied to Myf5-expressing progenitors to induce differentiation into brown fat cells. Oligodendrocytes may be specified from neural precursors using a synthetic, modified RNA encoding Ascl1. It has been reported that hepatocyte differentiation requires the transcription factor HNF-4α. (Li et al., Genes Dev. 14:464, 2000). A synthetic, modified RNA can be applied to a cell, such as a stem cell or induced pluripotent stem cell generated using the compositions described herein, that inhibit or suppress one or more component of the wnt/β-catenin pathway to become a cardiovascular progenitor cell. These examples are not meant to be limiting and essentially any cell-type specific factor or differentiation factor known in the art can be expressed in a cell using a synthetic, modified RNA or synthetic, modified RNA composition as described herein. Table 1 provides a non-limiting list of exemplary transcription factors and corresponding mRNA sequence identifiers that can be used to alter the developmental potential or phenotype of a cell.

In other embodiments, cells with higher or increased developmental potential, e.g., pluripotent cells, multipotent cells, etc., can be induced to differentiate by manipulating their external environment. For example, cells can be maintained under culture conditions that induce differentiation of the cells to a desired lineage. As but one example, in some embodiments, cells with higher or increased developmental potential, generated using the compositions and methods comprising synthetic, modified RNAs described herein, can be differentiated into islet-like cells for administration to a patient in need thereof, for example, a patient having or at risk for diabetes. In such embodiments, islet-like cells, which includes insulin-producing cells and glucagon-producing cells, can be differentiated using any of the methods described in US Patent Publication No.: 20100240130, the contents of which are herein incorporated in their entirety by reference. For example, cells can be differentiated whereby the first culturing step takes place in the presence of an Activin, the next culturing step utilizes a suspension culture that takes place in the presence of a noggin, an FGF-2, and an EGF, and a final culturing step in which the cells are cultured with nicotinamide. In certain embodiments, sodium butyrate can be included in the culture medium. In other embodiments, pluripotent cells can be differentiated into islet-like cells by directed differentiation. In certain embodiments, expression of additional genes at the site of islet-like cell administration, using the compositions and methods described herein, can facilitate adoption of the functional β-islet cell phenotype, enhance the beneficial effect of the administered cells, and/or increase proliferation and/or activity of host cells neighboring the treatment site.

In other embodiments, cells with higher or increased developmental potential, generated using the compositions and methods comprising synthetic, modified RNAs described herein, can be differentiated, for example, into neuronal cells, such as oligodendrocytes, for example, for treatment of spinal cord injuries. In such embodiments, pluripotent cells can be differentiated using any of the compositions or methods found in US Patent Publication No.: 20090232779 or US Patent Publication No.: 20090305405, the contents of each of which are herein incorporated in their entireties by reference. For example, cells can be differentiated to neural or glial lineages, using medium including any of the following factors in an effective combination: Brain derived neurotrophic factor (BDNF), neurotrophin-3 (NT-3), NT-4, epidermal growth factor (EGF), ciliary neurotrophic factor (CNTF), nerve growth factor (NGF), retinoic acid (RA), sonic hedgehog, FGF-8, ascorbic acid, forskolin, fetal bovine serum (FBS), and bone morphogenic proteins (BMPs).

In other exemplary embodiments, cells with higher or increased developmental potential generated using the compositions and methods comprising synthetic, modified RNAs described herein can be differentiated into heptaocyte-like cells for treatment of liver diseases, such as cirrhosis. For example, cells can be differentiated to hepatocyte-like cells, using medium including any of the following factors in an effective combination or sequence: a hepatocyte supportive extracellular matrix, such as collagen or Matrigel; suitable differentiation agents, such as various isomers of butyrate and their analogs, exemplified by n-butyrate; a hepatocyte maturation factor, such as an organic solvent like dimethyl sulfoxide (DMSO); a maturation cofactor such as retinoic acid; a cytokine or hormone such as a glucocorticoid, epidermal growth factor (EGF), insulin, transforming growth factors (TGF-α and TGF-β), fibroblast growth factors (FGF), heparin, hepatocyte growth factors (HGF), interleukins (IL-1 and IL-6), insulin-like growth factors (IGF-I and IGF-II), and heparin-binding growth factors (HBGF-1).

The success of a differentiation program can be monitored by any of a number of criteria, including characterization of morphological features, detection or quantitation of expressed cell markers and enzymatic activity, and determination of the functional properties of the desired end cell types in vitro or in vivo. The level of mRNA corresponding to a marker can be determined both by in situ and by in vitro formats. The isolated mRNA can be used in hybridization or amplification assays that include, but are not limited to, Southern or Northern analyses, polymerase chain reaction analyses and probe arrays. Protein markers can be measured e.g., by immunohistochemical techniques or the morphology of the cell can be monitored. Biochemical approaches, e.g., the ability of the differentiated cell to respond to a cell-type specific stimulus can also be monitored. An increase in the expression of a cell specific marker may be by about 5%, 10%, 25%, 50%, 75% or 100%. In one embodiment, the synthetic, modified RNA composition can direct cell fate towards different germ layers without definitively specifying a terminally differentiated cell type. For example, a synthetic, modified RNA encoding Sox17 or GATA6 can be used for definitive endodermal specification from pluripotent cells, such as an iPS or embryonic stem cell. Similarly, a synthetic, modified RNA encoding T (Brachyury) can be used for specification of mesoderm. For example, markers for neural cells include, but are not limited to: β-tubulin III or neurofilament, which are characteristic of neurons, glial fibrillary acidic protein (GFAP), present in astrocytes; galactocerebroside (GalC) or myelin basic protein (MBP), characteristic of oligodendrocytes; nestin, characteristic of neural precursors and other cells, and A2B5 and NCAM, characteristic of glial progenitors and neural progenitors, respectively. Similarly, an adipocyte can be detected by assaying for Oil-Red-O staining or acetylated LDL uptake. Cardiomyocytes can be detected by assaying for the expression of one or more cardiomyocyte specific markers, such as cardiotroponin I, Mef2c, connexin43, Nkx2.5, GATA-4, sarcomeric actinin, cariotroponin T and TBX5, and sarcomeric actinin, α-cardiac myosin heavy chain, actin, or ventricular myosin light chain 2 (MLC-2v). For skeletal muscle, markers include myoD, myogenin, and myf-5. Markers of interest for identifying liver cells include α-fetoprotein (liver progenitors); albumin, $\alpha_1$-antitrypsin, glucose-6-phosphatase, cytochrome p450 activity, transferrin, asialoglycoprotein receptor, and glycogen storage (hepatocytes); CK7, CK19, and γ-glutamyl transferase (bile epithelium). The presence of endothelial cells can be detected by assaying the presence of an endothelial cell specific marker, such as CD31+, PECAM (platelet endothelial cell adhesion molecule), Flk-1, tie-1, tie-2, vascular endothelial (VE) cadherin, MECA-32, and MEC-14.7. For pancreatic cells, pdx and insulin secretion can be used for determination of differentiation. The level of expression can be measured in a number of ways, including, but not limited to: measuring the mRNA encoded by the markers; measuring the amount of protein encoded by the markers; or measuring the activity of the protein encoded by the markers.

In some embodiments, differentiation is detected by measuring an alteration in the morphology or biological function or activity of a differentiated cell. An alteration in biological function may be assayed, for example, by measuring an increase in acetylated LDL uptake in a reprogrammed adipocyte. For example, GABA-secreting neurons can be identified by production of glutamic acid decarboxylase or GABA. Dopaminergic neurons can be identified by production of dopa decarboxylase, dopamine, or tyrosine hydroxylase.

Also, for example, differentiated hepatocyte lineage cells differentiated can be identified by $\alpha_1$-antitrypsin (AAT) synthesis, albumin synthesis, evidence of glycogen storage, evidence of cytochrome p450 activity, and evidence of glucose-6-phosphatase activity. Other methods for assaying cell morphology and function are known in the art and are described in the Examples.

In some embodiments, the cells of the compositions and methods described herein are further cultured in the presence of cell specific growth factors, such as angiogenin, bone morphogenic protein-1, bone morphogenic protein-2, bone morphogenic protein-3, bone morphogenic protein-4, bone morphogenic protein-5, bone morphogenic protein-6, bone morphogenic protein-7, bone morphogenic protein-8, bone morphogenic protein-9, bone morphogenic protein-10, bone morphogenic protein-11, bone morphogenic protein-12, bone morphogenic protein-13, bone morphogenic protein-14, bone morphogenic protein-15, bone morphogenic protein receptor IA, bone morphogenic protein receptor IB, brain derived neurotrophic factor, ciliary neutrophic factor, ciliary neutrophic factor receptor-alpha, cytokine-induced neutrophil chemotactic factor 1, cytokine-induced neutrophil, chemotactic factor 2-alpha, cytokine-induced neutrophil chemotactic factor 2-beta, beta-endothelial cell growth factor, endothelia 1, epidermal growth factor, epithelial-derived neutrophil attractant, fibroblast growth factor 4, fibroblast growth factor 5, fibroblast growth factor 6 fibroblast growth factor 7, fibroblast growth factor 8, fibroblast growth factor b, fibroblast growth factor c, fibroblast growth factor 9, fibroblast growth factor 10, fibroblast growth factor acidic, fibroblast growth factor basic, glial cell line-derived neutrophil factor receptor-alpha-1, glial cell line-derived neutrophil factor receptor-alpha-2, growth related protein, growth related protein-alpha, growth related protein-beta, growth related protein-gamma, heparin binding epidermal growth factor, hepatocyte growth factor, hepatocyte growth factor receptor, insulin-like growth factor I, insulin-like growth factor receptor, insulin-like growth factor II, insulin-like growth factor binding protein, keratinocyte growth factor, leukemia inhibitory factor, leukemia inhibitory factor receptor-alpha, nerve growth factor, nerve growth factor receptor, neurotrophin-3, neurotrophin-4, placenta growth factor, placenta growth factor 2, platelet-derived endothelial cell growth factor, platelet derived growth factor, platelet derived growth factor A chain, platelet derived growth factor AA, platelet derived growth factor AB, platelet derived growth factor B chain, platelet derived growth factor BB, platelet derived growth factor receptor-alpha, platelet derived growth factor receptor-beta, pre-B cell growth stimulating factor, stem cell factor, stem cell factor receptor, transforming growth factor-alpha, transforming growth factor-beta, transforming growth factor-beta-1, transforming growth factor-beta-1-2, transforming growth factor-beta-2, transforming growth factor-beta-3, transforming growth factor-beta-5, latent transforming growth factor-beta-1, transforming growth factor-beta-binding protein I, transforming growth factor-beta-binding protein II, transforming growth factor-beta-binding protein III, tumor necrosis factor receptor type I, tumor necrosis factor receptor type II, urokinase-type plasminogen activator receptor, vascular endothelial growth factor, and chimeric proteins and biologically or immunologically active fragments thereof. Such factors can also be injected or otherwise administered directly into an animal system for in vivo integration.

Cell Modifications

Homing Moieties and Cell-Surface Receptors

In some aspects and embodiments of the aspects described herein, a synthetic, modified RNA can be used to express a ligand or ligand receptor on the surface of a cell (e.g., a homing moiety). A ligand or ligand receptor moiety attached to a cell surface permits the cell to have a desired biological interaction with a tissue or an agent in vivo. A ligand can be an antibody, an antibody fragment, an aptamer, a peptide, a vitamin, a carbohydrate, a protein or polypeptide, a receptor, e.g., cell-surface receptor, an adhesion molecule, a glycoprotein, a sugar residue, a therapeutic agent, a drug, a glycosaminoglycan, or any combination thereof. For example, a ligand can be an antibody that recognizes a cancer-cell specific antigen, rendering the cell capable of preferentially interacting with tumor cells to permit tumor-specific localization of a modified cell. A ligand can confer the ability of a cell composition to accumulate in a tissue to be treated, since a preferred ligand is capable of interacting with a target molecule on the external face of a tissue to be treated. Ligands having limited cross-reactivity to other tissues are generally preferred.

In some cases, a ligand can act as a homing moiety which permits the cell to target to a specific tissue or interact with a specific ligand. Such homing moieties can include, for example, any member of a specific binding pair, antibodies, monoclonal antibodies, or derivatives or analogs thereof, including without limitation: Fv fragments, single chain Fv (scFv) fragments, Fab' fragments, F(ab')$_2$ fragments, single domain antibodies, camelized antibodies and antibody fragments, humanized antibodies and antibody fragments, and multivalent versions of the foregoing; multivalent binding reagents including without limitation: monospecific or bispecific antibodies, such as disulfide stabilized Fv fragments, scFv tandems ((scFv)$_2$ fragments), diabodies, tribodies or tetrabodies, which typically are covalently linked or otherwise stabilized (i.e., leucine zipper or helix stabilized) scFv fragments; and other homing moieties include for example, aptamers, receptors, and fusion proteins.

In some embodiments, the homing moiety is a surface-bound antibody, which can permit tuning of cell targeting specificity. This is especially useful since highly specific antibodies can be raised against an epitope of interest for the desired targeting site. In one embodiment, multiple antibodies are expressed on the surface of a cell, and each antibody can have a different specificity for a desired target. Such approaches can increase the avidity and specificity of homing interactions.

A skilled artisan can select any homing moiety based on the desired localization or function of the cell, for example an estrogen receptor ligand, such as tamoxifen, can target cells to estrogen-dependent breast cancer cells that have an increased number of estrogen receptors on the cell surface. Other non-limiting examples of ligand/receptor interactions include CCR1 (e.g., for treatment of inflamed joint tissues or brain in rheumatoid arthritis, and/or multiple sclerosis), CCR7, CCR8 (e.g., targeting to lymph node tissue), CCR6, CCR9, CCR10 (e.g., to target to intestinal tissue), CCR4, CCR10 (e.g., for targeting to skin), CXCR4 (e.g., for general enhanced transmigration), HCELL (e.g., for treatment of inflammation and inflammatory disorders, bone marrow), Alpha4beta7 (e.g., for intestinal mucosa targeting), VLA-4/VCAM-1 (e.g., targeting to endothelium). In general, any receptor involved in targeting (e.g., cancer metastasis) can be harnessed for use in the methods and compositions described herein. Table 2 and Table 3 provide non-limiting examples of CD ("cluster of differentiation") molecules and other cell-surface/membrane bound molecules and receptors that can be expressed using the synthetic, modified RNA compositions and methods described herein for targeting and homing to cells of interest, or for changing the phenotype of a cell.

Mediators of Cell Death

In one embodiment, a synthetic, modified RNA composition can be used to induce apoptosis in a cell (e.g., a cancer cell) by increasing the expression of a death receptor, a death receptor ligand or a combination thereof. This method can be used to induce cell death in any desired cell and has particular usefulness in the treatment of cancer where cells escape natural apoptotic signals.

Apoptosis can be induced by multiple independent signaling pathways that converge upon a final effector mechanism consisting of multiple interactions between several "death receptors" and their ligands, which belong to the tumor necrosis factor (TNF) receptor/ligand superfamily. The best-characterized death receptors are CD95 ("Fas"), TNFR1 (p55), death receptor 3 (DR3 or Apo3/TRAMO), DR4 and DR5 (apo2-TRAIL-R2). The final effector mechanism of apoptosis is the activation of a series of proteinases designated as caspases. The activation of these caspases results in the cleavage of a series of vital cellular proteins and cell death. The molecular mechanism of death receptors/ligands-induced apoptosis is well known in the art. For example, Fas/FasL-mediated apoptosis is induced by binding of three FasL molecules which induces trimerization of Fas receptor via C-terminus death domains (DDs), which in turn recruit an adapter protein FADD (Fas-associated protein with death domain) and Caspase-8. The oligomerization of this trimolecular complex, Fas/FAIDD/caspase-8, results in proteolytic cleavage of proenzyme caspase-8 into active caspase-8 that, in turn, initiates the apoptosis process by activating other downstream caspases through proteolysis, including caspase-3. Death ligands in general are apoptotic when formed into trimers or higher order of structures. As monomers, they may serve as antiapoptotic agents by competing with the trimers for binding to the death receptors.

In one embodiment, the synthetic, modified RNA composition encodes for a death receptor (e.g., Fas, TRAIL, TRAMO, TNFR, TLR etc). Cells made to express a death receptor by transfection of modified RNA become susceptible to death induced by the ligand that activates that receptor. Similarly, cells made to express a death ligand, e.g., on their surface, will induce death of cells with the receptor when the transfected cell contacts the target cell. In another embodiment, the modified RNA composition encodes for a death receptor ligand (e.g., FasL, TNF, etc). In another embodiment, the modified RNA composition encodes a caspase (e.g., caspase 3, caspase 8, caspase 9 etc). Where cancer cells often exhibit a failure to properly differentiate to a non-proliferative or controlled proliferative form, in another embodiment, the synthetic, modified RNA composition encodes for both a death receptor and its appropriate activating ligand. In another embodiment, the synthetic, modified RNA composition encodes for a differentiation factor that when expressed in the cancer cell, such as a cancer stem cell, will induce the cell to differentiate to a non-pathogenic or non-self-renewing phenotype (e.g., reduced cell growth rate, reduced cell division etc) or to induce the cell to enter a dormant cell phase (e.g., $G_0$ resting phase).

One of skill in the art will appreciate that the use of apoptosis-inducing techniques will require that the synthetic, modified RNAs are appropriately targeted to e.g., tumor cells to prevent unwanted wide-spread cell death. Thus, one can use a delivery mechanism (e.g., attached ligand or antibody, targeted liposome etc) that recognizes a cancer antigen such that the modified RNAs are expressed only in cancer cells.

Cellular Therapies and Cellular Administration

The compositions and methods comprising synthetic, modified RNAs are particularly useful for generating cells, such as differentiated cells, for use in patients in need of cellular therapies or regenerative medicine applications. Accordingly, various embodiments of the methods and compositions described herein involve administration of an effective amount of a cell or a population of cells, generated using any of the compositions or methods comprising synthetic, modified RNAs described herein, to an individual or subject in need of a cellular therapy. The cell or population of cells being administered can be an autologous population, or be derived from one or more heterologous sources. The cell can be, for example, a stem cell, such as a lineage-restricted progenitor cell, multipotent cell, or an oligopotent cell, or a fully or partially differentiated progeny of a stem cell. In some embodiments, the stem cell can be generated through the introduction of synthetic, modified RNAs encoding differentiation factor(s) as described herein. In addition, the population of cells administered can be of a lineage selected from one of an ecotodermal lineage, a mesodermal lineage, or an endodermal lineage. The cell can also be a cell modified to express a targeting moiety or a mediator of targeted cell death, using synthetic, modified RNAs as described herein. Further, such differentiated cells can be administered in a manner that permits them to graft to the intended tissue site and reconstitute or regenerate the functionally deficient area. In some such embodiments, differentiated cells can be introduced to a scaffold or other structure to generate, for example, a tissue ex vivo, that can then be introduced to a patient. For example, islet precursor cells or their derivatives can be generated to restore islet function in a patient having any condition relating to inadequate production of a pancreatic endocrine (insulin, glucagon, or somatostatin), or the inability to properly regulate secretion, e.g., Type I (insulin-dependent) diabetes mellitus.

A variety of means for administering cells to subjects are known to those of skill in the art. Such methods can include systemic injection, for example i.v. injection, or implantation of cells into a target site in a subject. Cells may be inserted into a delivery device which facilitates introduction by injection or implantation into the subject. Such delivery devices can include tubes, e.g., catheters, for injecting cells and fluids into the body of a recipient subject. In one preferred embodiment, the tubes additionally have a needle, e.g., through which the cells can be introduced into the subject at a desired location. The cells can be prepared for delivery in a variety of different forms. For example, the cells can be suspended in a solution or gel or embedded in a support matrix when contained in such a delivery device. Cells can be mixed with a pharmaceutically acceptable carrier or diluent in which the cells remain viable.

Pharmaceutically acceptable carriers and diluents include saline, aqueous buffer solutions, solvents and/or dispersion media. The use of such carriers and diluents is well known in the art. The solution is preferably sterile and fluid. Preferably, prior to the introduction of cells as described herein, the solution is stable under the conditions of manufacture and storage and preserved against the contaminating action of microorganisms such as bacteria and fungi through the use of, for example, parabens, chlorobutanol, phenol, ascorbic acid, thimerosal, and the like.

It is preferred that the mode of cell administration is relatively non-invasive, for example by intravenous injection, pulmonary delivery through inhalation, topical, or intranasal administration. However, the route of cell administration will depend on the tissue to be treated and may include implantation. Methods for cell delivery are known to those of skill in the art and can be extrapolated by one skilled in the art of medicine for use with the methods and compositions described herein.

Direct injection techniques for cell administration can also be used to stimulate transmigration of cells through the entire vasculature, or to the vasculature of a particular organ, such as for example liver, or kidney or any other organ. This includes non-specific targeting of the vasculature. One can target any organ by selecting a specific injection site, e.g., a liver portal vein. Alternatively, the injection can be performed systemically into any vein in the body. This method is useful for enhancing stem cell numbers in aging patients. In addition, the cells can function to populate vacant stem cell niches or create new stem cells to replenish the organ, thus improving organ function. For example, cells may take up pericyte locations within the vasculature. In another example, neural stem cells or precursor cells generated using the compositions and methods comprising synthetic, modified RNAs are transplanted directly into parenchymal or intrathecal sites of the central nervous system, according to the disease being treated, such as for example, a spinal cord injury. Grafts can be done using single cell suspension or small aggregates at a density of 25,000-500,000 cells per mL (U.S. Pat. No. 5,968, 829, the contents of which are herein incorporated in their entireties by reference). A successful transplant can show, for example, transplant-derived cells present in the lesion 2-5 weeks later, differentiated into astrocytes, oligodendrocytes, and/or neurons, and migrating along the cord from the lesioned end.

If so desired, a mammal or subject can be pre-treated with an agent, for example an agent is administered to enhance cell targeting to a tissue (e.g., a homing factor) and can be placed at that site to encourage cells to target the desired tissue. For example, direct injection of homing factors into a tissue can be performed prior to systemic delivery of ligand-targeted cells.

Scaffolds and Tissue Engineering

It is further contemplated that, in some embodiments of these aspects, cells generated by differentiation or transdifferentiation using the synthetic, modified RNAs described herein, can not only be administered as cells in suspension, but also as cells populating a matrix, scaffold, or other support to create an artificial tissue, for use in cellular therapies in regenerative medicine and tissue engineering.

Tissue engineering refers to the use of a combination of cells, engineering and materials methods, and suitable biochemical and physio-chemical factors for the de novo generation of tissue or tissue structures. Such engineered tissue or tissue structures are useful for therapeutic purposes to improve or replace biological functions. As used herein, "engineered tissue" encompasses a broad range of applications, including, but not limited to, utility in the repair or replace portions of, or whole tissues (e.g., heart, cardiac tissue, ventricular myocardium, and other tissues such as bone, cartilage, pancreas, liver, kidney, blood vessels, bladder, etc.), or in assays for identifying agents which modify the function of parts of, or entire organs without the need to obtain such organs from a subject.

In some embodiments, a "support" i.e., any suitable carrier material to which cells generated using the methods and compositions comprising synthetic, modified RNAs described herein are able to attach themselves or adhere, is used in order to form a corresponding cell composite, e.g. an artificial tissue. In some embodiments, a matrix or carrier material, respectively, is present already in a three-dimensional form desired for later application. For example, bovine pericardial tissue can be used as matrix which is crosslinked with collagen, decellularized and photofixed.

In some such embodiments, a scaffold, which can also be referred to as a "biocompatible substrate," can be used as a material that is suitable for implantation into a subject onto which a cell population can be deposited. A biocompatible substrate does not cause toxic or injurious effects once implanted in the subject. In one embodiment, the biocompatible substrate is a polymer with a surface that can be shaped into a desired structure that requires repairing or replacing. The polymer can also be shaped into a part of a structure that requires repairing or replacing. The biocompatible substrate provides the supportive framework that allows cells to attach to it, and grow on it. Cultured populations of cells can then be grown on the biocompatible substrate, which provides the appropriate interstitial distances required for cell-cell interaction.

A structure or scaffold can be used to aid in further controlling and directing a cell or population of cells undergoing differentiation or transdifferentiation using the compositions and methods described herein. A structure or scaffold, such as a biopolymer structure, can be designed to provide environmental cues to control and direct the differentiation of cells to a functionally active engineered tissue, e.g., multipotent cells undergoing differentiation, using the synthetic, modified RNAs described herein, into ventricular cardiomyocytes to generate a functional, contracting tissue myocardium structure. By "functionally active," it is meant that the cell attached to the scaffold comprises at least one function of that cell type in its native environment. A structure or scaffold can be engineered from a nanometer to micrometer to millimeter to macroscopic length, and can further comprise or be based on factors such as, but not limited to, material mechanical properties, material solubility, spatial patterning of bioactive compounds, spatial patterning of topological features, soluble bioactive compounds, mechanical perturbation (cyclical or static strain, stress, shear, etc. . . . ), electrical stimulation, and thermal perturbation.

The construction of an engineered tissue can be carried out by first assembling the scaffolds, and then seeding with a cell type that has undergone differentiation or partial differentiation using the synthetic, modified RNA compositions and methods described herein. Alternatively, an engineered tissue can be made by seeding a matrix or other scaffold component cell with cells, such as iPS cells or human ES cells, and applying or introducing a desired synthetic, modified RNA composition directly to the scaffold comprising the cells. A scaffold can be in any desired geometric conformation, for example, a flat sheet, a spiral, a cone, a v-like structure and the like. A scaffold can be shaped into, e.g., a heart valve, vessel (tubular), planar construct or any other suitable shape. Such scaffold constructs are known in the art (see, e.g., WO02/035992, U.S. Pat. Nos. 6,479,064, 6,461,628, the contents of which are herein incorporated in their entireties by reference). In some embodiments, after culturing the cells on the scaffold, the scaffold is removed (e.g., bioabsorbed or physically removed), and the layers of differentiation or transdifferentiated cells maintain substantially the same conformation as the scaffold, such that, for example, if the scaffold was spiral shaped, the cells form a 3D-engineered tissue that is spiral shaped. In addition, it is contemplated that different synthetic, modified RNA compositions can be contacted with or applied to a scaffold comprising cells in order to allow the growth and differentiation of a plurality of different, differentiated cells types to form a desired engineered tissue. For example, for construction of muscle tissue with blood vessels, a scaffold can be seeded with different population of cells which make up blood vessels, neural tissue, cartilage, tendons, ligaments and the like.

Biopolymer structures can be generated by providing a transitional polymer on a substrate; depositing a biopolymer on the transitional polymer; shaping the biopolymer into a structure having a selected pattern on the transitional polymer (poly(N-Isopropylacrylamide); and releasing the biopolymer from the transitional polymer with the biopolymer's structure and integrity intact. A biopolymer can be selected from an extracellular matrix (ECM) protein, growth factor, lipid, fatty acid, steroid, sugar and other biologically active carbohydrates, a biologically derived homopolymer, nucleic acids, hormone, enzyme, pharmaceutical composition, cell surface ligand and receptor, cytoskeletal filament, motor protein, silks, polyprotein (e.g., poly(lysine)) or any combination thereof. The biopolymers used in the generation of the scaffolds for the embodiments directed to tissue engineering described herein include, but are not limited to, a) extracellular matrix proteins to direct cell adhesion and function (e.g., collagen, fibronectin, laminin, etc.); (b) growth factors to direct cell function specific to cell type (e.g., nerve growth factor, bone morphogenic proteins, vascular endothelial growth factor, etc.); (c) lipids, fatty acids and steroids (e.g., glycerides, non-glycerides, saturated and unsaturated fatty acids, cholesterol, corticosteroids, sex steroids, etc.); (d) sugars and other biologically active carbohydrates (e.g., monosaccharides, oligosaccharides, sucrose, glucose, glycogen, etc.); (e) combinations of carbohydrates, lipids and/or proteins, such as proteoglycans (protein cores with attached side chains of chondroitin sulfate, dermatan sulfate, heparin, heparan sulfate, and/or keratan sulfate); glycoproteins [e.g., selectins, immunoglobulins, hormones such as human chorionic gonadotropin, Alpha-fetoprotein and Erythropoietin (EPO), etc.]; proteolipids (e.g., N-myristoylated, palmitoylated and prenylated proteins); and glycolipids (e.g., glycoglycerolipids, glycosphingolipids, glycophosphatidylinositols, etc.); (f) biologically derived homopolymers, such as polylactic and polyglycolic acids and poly-L-lysine; (g) nucleic acids (e.g., DNA, RNA, etc.); (h) hormones (e.g., anabolic steroids, sex hormones, insulin, angiotensin, etc.); (i) enzymes (types: oxidoreductases, transferases, hydrolases, lyases, isomerases, ligases; examples: trypsin, collegenases, matrix metallproteinases, etc.); (j) pharmaceuticals (e.g., beta blockers, vasodilators, vasoconstrictors, pain relievers, gene therapy, viral vectors, anti-inflammatories, etc.); (k) cell surface ligands and receptors (e.g., integrins, selectins, cadherins, etc.); (l) cytoskeletal filaments and/or motor proteins (e.g., intermediate filaments, microtubules, actin filaments, dynein, kinesin, myosin, etc.), or any combination thereof. For example, a biopolymer can be selected from the group consisting of fibronectin, vitronectin, laminin, collagen, fibrinogen, silk or silk fibroin.

Following or during construction of a biopolymer scaffold, cells can be integrated into or onto the scaffold. In some embodiments, the cells to be differentiated are human ES-derived cells or iPS-derived cells, and the methods further comprise growing the cells in the scaffold where the structure, composition, ECM type, growth factors and/or other cell types can assist in differentiation of the cells into the desired differentiated cell type. In some embodiments, such engineered tissue can be further used in drug screening applications. For example, an engineered myocardium tissue composition can be useful as a tool to identify agents which modify the function of cardiac muscle (e.g., to identify cardiotoxic agents).

Other exemplary materials suitable for polymer scaffold fabrication include, but are not limited to, polylactic acid (PLA), poly-L-lactic acid (PLLA), poly-D-lactic acid (PDLA), polyglycolide, polyglycolic acid (PGA), polylactide-co-glycolide (PLGA), polydioxanone, polygluconate, polylactic acid-polyethylene oxide copolymers, modified cellulose, collagen, polyhydroxybutyrate, polyhydroxpriopionic acid, polyphosphoester, poly(alpha-hydroxy acid), polycaprolactone, polycarbonates, polyamides, polyanhydrides, polyamino acids, polyorthoesters, polyacetals, polycyanoacrylates, degradable urethanes, aliphatic polyester polyacrylates, polymethacrylate, acyl substituted cellulose acetates, non-degradable polyurethanes, polystyrenes, polyvinyl chloride, polyvinyl flouride, polyvinyl imidazole, chlorosulphonated polyolifins, polyethylene oxide, polyvinyl alcohol, Teflon™, nylon silicon, and shape memory materials, such as poly(styrene-block-butadiene), polynorbornene, hydrogels, metallic alloys, and oligo(ε-caprolactone)diol as switching segment/oligo(p-dioxyanone)diol as physical crosslink Other suitable polymers can be obtained by reference to The Polymer Handbook, 3rd edition (Wiley, N.Y., 1989), the contents of which are herein incorporated in their reference by entirety.

In some embodiments, additional bioactive substances can be added to a biopolymer scaffold comprising cells being differentiated using the synthetic, modified RNA compositions described herein, such as, but not limited to, demineralized bone powder as described in U.S. Pat. No. 5,073,373 the contents of which are incorporated herein by reference; collagen, insoluble collagen derivatives, etc., and soluble solids and/or liquids dissolved therein; antiviricides, particularly those effective against HIV and hepatitis; antimicrobials and/or antibiotics such as erythromycin, bacitracin, neomycin, penicillin, polymycin B, tetracyclines, biomycin, chloromycetin, and streptomycins, cefazolin, ampicillin, azactam, tobramycin, clindamycin and gentamycin, etc.; biocidal/biostatic sugars such as dextran, glucose, etc.; amino acids; peptides; vitamins; inorganic elements; co-factors for protein synthesis; hormones; endocrine tissue or tissue fragments; synthesizers; enzymes such as alkaline phosphatase, collagenase, peptidases, oxidases, etc.; polymer cell scaffolds with parenchymal cells; angiogenic agents and polymeric carriers containing such agents; collagen lattices; antigenic agents; cytoskeletal agents; cartilage fragments; living cells such as chondrocytes, bone marrow cells, mesenchymal stem cells; natural extracts; genetically engineered living cells or otherwise modified living cells; expanded or cultured cells; DNA delivered by plasmid, viral vectors or other means; tissue transplants; demineralized bone powder; autogenous tissues such as blood, serum, soft tissue, bone marrow, etc.; bioadhesives; bone morphogenic proteins (BMPs); osteoinductive factor (IFO); fibronectin (FN); endothelial cell growth factor (ECGF); vascular endothelial growth factor (VEGF); cementum attachment extracts (CAE); ketanserin; human growth hormone (HGH); animal growth hormones; epidermal growth factor (EGF); interleukins, e.g., interleukin-1 (IL-1), interleukin-2 (IL-2); human alpha thrombin; transforming growth factor (TGF-beta); insulin-like growth factors (IGF-1, IGF-2); platelet derived growth factors (PDGF); fibroblast growth factors (FGF, BFGF, etc.); periodontal ligament chemotactic factor (PDLGF); enamel matrix proteins; growth and differentiation factors (GDF); hedgehog family of proteins; protein receptor molecules; small peptides derived from growth factors above; bone promoters; cytokines; somatotropin; bone digestors; antitumor agents; cellular attractants and attachment agents; immuno-suppressants; permeation enhancers, e.g., fatty acid esters such as laureate, myristate and stearate monoesters of polyethylene glycol, enamine derivatives, alpha-keto aldehydes, etc.; and nucleic acids. The amounts of such optionally added bioactive substances can vary widely with optimum levels being readily determined in a specific case by routine experimentation.

Diseases Treatable by Cell Transplantation

A wide range of diseases are recognized as being treatable with cellular therapies. Accordingly, also provided herein are compositions and methods comprising synthetic, modified RNAs for generating cells for use in cellular therapies, such as stem cell therapies. As non-limiting examples, these include diseases marked by a failure of naturally occurring stem cells, such as aplastic anemia, Fanconi anemia, and paroxysmal nocturnal hemoglobinuria (PNH). Others include, for example: acute leukemias, including acute lymphoblastic leukemia (ALL), acute myelogenous leukemia (AML), acute biphenotypic leukemia and acute undifferentiated leukemia; chronic leukemias, including chronic myelogenous leukemia (CML), chronic lymphocytic leukemia (CLL), juvenile chronic myelogenous leukemia (JCML) and juvenile myelomonocytic leukemia (JMML); myeloproliferative disorders, including acute myelofibrosis, angiogenic myeloid metaplasia (myelofibrosis), polycythemia vera and essential thrombocythemia; lysosomal storage diseases, including mucopolysaccharidoses (MPS), Hurler's syndrome (MPS-IH), Scheie syndrome (MPS-IS), Hunter's syndrome (MPS-II), Sanfilippo syndrome (MPS-III), Morquio syndrome (MPS-IV), Maroteaux-Lamy Syndrome (MPS-VI), Sly syndrome, beta-glucuronidase deficiency (MPS-VII), adrenoleukodystrophy, mucolipidosis II (I-cell Disease), Krabbe disease, Gaucher's disease, Niemann-Pick disease, Wolman disease and metachromatic leukodystrophy; histiocytic disorders, including familial erythrophagocytic lymphohistiocytosis, histiocytosis-X and hemophagocytosis; phagocyte disorders, including Chediak-Higashi syndrome, chronic granulomatous disease, neutrophil actin deficiency and reticular dysgenesis; inherited platelet abnormalities, including amegakaryocytosis/congenital thrombocytopenia; plasma cell disorders, including multiple myeloma, plasma cell leukemia, and Waldenstrom's macroglobulinemia. Other malignancies treatable with stem cell therapies include but are not limited to breast cancer, Ewing sarcoma, neuroblastoma and renal cell carcinoma, among others. Also treatable with stem cell therapy are: lung disorders, including COPD and bronchial asthma; congenital immune disorders, including ataxia-telangiectasia, Kostmann syndrome, leukocyte adhesion deficiency, DiGeorge syndrome, bare lymphocyte syndrome, Omenn's syndrome, severe combined immunodeficiency (SCID), SCID with adenosine deaminase deficiency, absence of T & B cells SCID, absence of T cells, normal B cell SCID, common variable immunodeficiency and X-linked lymphoproliferative disorder; other inherited disorders, including Lesch-Nyhan syndrome, cartilage-hair hypoplasia, Glanzmann thrombasthenia, and osteopetrosis; neurological conditions, including acute and chronic stroke, traumatic brain injury, cerebral palsy, multiple sclerosis, amyotrophic lateral sclerosis and epilepsy; cardiac conditions, including atherosclerosis, congestive heart failure and myocardial infarction; metabolic disorders, including diabetes; and ocular disorders including macular degeneration and optic atrophy. Such diseases or disorders can be treated either by administration of stem cells themselves, permitting in vivo differentiation to the desired cell type with or without the administration of agents to promote the desired differentiation, or by administering stem cells differentiated to the desired cell type in vitro. Efficacy of treatment is determined by a statistically significant change in one or more indicia of the targeted disease or disorder.

Dosage and Administration

Dosage and administration will vary with the condition to be treated and the therapeutic approach taken in a given instance.

Depending on the disease or disorder being treated and on the approach being taken, cells over a range of, for example, $2-5\times10^5$, or more, e.g., $1\times10^6$, $1\times10^7$, $1\times10^8$, $5\times10^8$, $1\times10^9$, $5\times10^9$, $1\times10^{10}$, $5\times10^{10}$ or more can be administered. Where differentiated cells are to be administered, the dose will most often be higher than where stem cells are administered, because differentiated cells will have reduced or limited capacity for self-renewal compared to stem cells. Repeat administration of differentiated cells may be necessary if the cells are not capable of self-renewal.

It is contemplated that cells generated by differentiation or transdifferentiation can be administered as cells in suspension, or as cells populating a matrix, scaffold, or other support to create an artificial tissue. To this end, resorbable matrices and scaffolds are known in the art, as are approaches for populating them with cells, as has been described herein. As but one example, matrices fabricated out of silk proteins are well suited as supports for cells, and are known to be well tolerated for implantation. Cells as described herein can be seeded on such matrices either alone or in combination with other cells, including autologous cells from the intended recipient, to provide the necessary environment for growth and maintenance of the cells in the desired differentiated (or non-differentiated) state. It is also contemplated that the cells generated by differentiation or transdifferentiation can be administered to a subject in need thereof, in an encapsulated form, according to known encapsulation technologies, including microencapsulation (see, e.g., U.S. Pat. Nos. 4,352,883; 4,353,888; and 5,084,350, which are incorporated herein in their entireties by reference). Where the differentiated or transdifferentiated cells are encapsulated, in some embodiments the cells are encapsulated by macroencapsulation, as described in U.S. Pat. Nos. 5,284,761; 5,158,881; 4,976,859; 4,968,733; 5,800,828 and published PCT patent application WO 95/05452, which are incorporated herein in their entireties by reference. In such embodiments, cells on the order of $1\times10^6$, $1\times10^7$, $1\times10^8$, $5\times10^8$, $1\times10^9$, $5\times10^9$, $1\times10^{10}$, $5\times10^{10}$ or more can be administered alone or on a matrix or support.

In other embodiments, cells can be suspended in a gel for administration to keep them relatively localized.

The success of treatment can be evaluated by the ordinarily skilled clinician by monitoring one or more symptoms or markers of the disease or disorder being treated by administration of the cells. Effective treatment includes any statistically significant improvement in one or more indicia of the disease or disorder. Where appropriate, a clinically accepted grade or scaling system for the given disease or disorder can be applied, with an improvement in the scale or grade being indicative of effective treatment.

In those aspects and embodiments where synthetic, modified RNAs are to be administered directly, instead of cells treated with or resulting from treatment with synthetic, modified RNA, the dosages will also vary depending upon the approach taken, the mode of delivery and the disease to be treated. For example, systemic administration without a targeting approach will generally require greater amounts of synthetic, modified RNA than either local administration or administration that employs a targeting or homing approach. Depending upon the targeted cell or tissue and the mode of delivery, effective dosages of synthetic, modified RNA can include, for example, 1 ng/kg of body weight up to a gram or more per kg of body weight and any amount in between. Preferred amounts can be, for example, in the range of 5 µg/kg body weight to 30 µg/kg of body weight or any amount in between. Dosages in such ranges can be administered once, twice, three times, four times or more per day, or every two days, every three days, every four days, once a week, twice a month, once a month or less frequently over a duration of days, weeks or months, depending on the condition being treated—where the therapeutic approach treats or ameliorates but does not permanently cure the disease or disorder, e.g., where the synthetic, modified RNA effects treatment of a metabolic disorder by expression of a protein that is deficient in the subject, administration of modified RNA can be repeated over time as needed. Where, instead, the synthetic, modified RNA leads to the establishment of a cell compartment that maintains itself and treats the disease or disorder, readministration may become unnecessary. Sustained release formulations of synthetic, modified RNA compositions are specifically contemplated herein. Continuous, relatively low doses are contemplated after an initial higher therapeutic dose.

A pharmaceutical composition that includes at least one synthetic, modified RNA described herein can be delivered to or administered to a subject by a variety of routes depending upon whether local or systemic treatment is desired and upon the area to be treated. Exemplary routes include parenteral, intrathecal, parenchymal, intravenous, nasal, oral, and ocular delivery routes. Parenteral administration includes intravenous drip, subcutaneous, intraperitoneal or intramuscular injection, or intrathecal or intraventricular administration. A synthetic, modified RNA can be incorporated into pharmaceutical compositions suitable for administration. For example, compositions can include one or more synthetic, modified RNAs and a pharmaceutically acceptable carrier. Supplementary active compounds can also be incorporated into the compositions. Compositions for intrathecal or intraventricular administration of synthetic, modified RNAs can include sterile aqueous solutions that can also contain buffers, diluents and other suitable additives.

In some embodiments, the effective dose of a synthetic, modified RNA can be administered in a single dose or in two or more doses, as desired or considered appropriate under the specific circumstances. If desired to facilitate repeated or frequent infusions, a non-implantable delivery device, e.g., needle, syringe, pen device, or implantatable delivery device, e.g., a pump, semi-permanent stent (e.g., intravenous, intraperitoneal, intracisternal or intracapsular), or reservoir can be advisable. In some such embodiments, the delivery device can include a mechanism to dispense a unit dose of the pharmaceutical composition comprising a synthetic, modified RNA. In some embodiments, the device releases the pharmaceutical composition comprising a synthetic, modified RNA continuously, e.g., by diffusion. In some embodiments, the device can include a sensor that monitors a parameter within a subject. For example, the device can include pump, e.g., and, optionally, associated electronics. Exemplary devices include stents, catheters, pumps, artificial organs or organ components (e.g., artificial heart, a heart valve, etc.), and sutures.

As used herein, "topical delivery" can refer to the direct application of a synthetic, modified RNA to any surface of the body, including the eye, a mucous membrane, surfaces of a body cavity, or to any internal surface. Formulations for topical administration may include transdermal patches, ointments, lotions, creams, gels, drops, sprays, and liquids. Conventional pharmaceutical carriers, aqueous, powder or oily bases, thickeners and the like may be necessary or desirable. Topical administration can also be used as a means to selectively deliver the synthetic, modified RNA to the epidermis or dermis of a subject, or to specific strata thereof, or to an underlying tissue.

Formulations for parenteral administration can include sterile aqueous solutions which can also contain buffers, diluents and other suitable additives. Intraventricular injection may be facilitated by an intraventricular catheter, for example, attached to a reservoir. For intravenous use, the total concentration of solutes should be controlled to render the preparation isotonic.

A synthetic, modified RNA can be administered to a subject by pulmonary delivery. Pulmonary delivery compositions can be delivered by inhalation by the patient of a dispersion so that the composition comprising a synthetic, modified RNA, within the dispersion can reach the lung where it can be readily absorbed through the alveolar region directly into the lung cells to directly transfect the lung cells, and/or enter the blood circulation. Direct transfection by inhalation will allow expression of a desired protein, for example CFTR, by the transfected lung cells. Accordingly, pulmonary delivery can be effective both for systemic delivery and for localized delivery to treat diseases of the lungs. Pulmonary delivery can be achieved by different approaches, including the use of nebulized, aerosolized, micellular and dry powder-based formulations of the compositions comprising synthetic, modified RNAs described herein. Delivery can be achieved with liquid nebulizers, aerosol-based inhalers, and dry powder dispersion devices. Metered-dose devices are preferred. One of the benefits of using an atomizer or inhaler is that the potential for contamination is minimized because the devices are self contained. Dry powder dispersion devices, for example, deliver drugs that can be readily formulated as dry powders. A synthetic, modified RNA composition can be stably stored as lyophilized or spray-dried powders by itself or in combination with suitable powder carriers. The delivery of a composition comprising a synthetic, modified RNA for inhalation can be mediated by a dosing timing element which can include a timer, a dose counter, time measuring device, or a time indicator which when incorporated into the device enables dose tracking, compliance monitoring, and/or dose triggering to a patient during administration of the aerosol medicament.

A synthetic, modified RNA can be modified such that it is capable of traversing the blood brain barrier. For example, the synthetic, modified RNA can be conjugated to a molecule that enables the agent to traverse the barrier. Such conjugated synthetic, modified RNA can be administered by any desired method, such as by intraventricular or intramuscular injection, or by pulmonary delivery, for example.

A composition comprising a synthetic, modified RNA described herein can also be delivered through the use of implanted, indwelling catheters that provide a means for injecting small volumes of fluid containing the synthetic, modified RNAs described herein directly into local tissues. The proximal end of these catheters can be connected to an implanted, access port surgically affixed to the patient's body, or to an implanted drug pump located in, for example, the patient's torso.

Alternatively, implantable delivery devices, such as an implantable pump can be employed. Examples of the delivery devices for use with the compositions comprising a synthetic, modified RNA described herein include the Model 8506 investigational device (by Medtronic, Inc. of Minneapolis, Minn.), which can be implanted subcutaneously in the body or on the cranium, and provides an access port through which therapeutic agents can be delivered. In addition to the aforementioned device, the delivery of the compositions comprising a synthetic, modified RNA described herein can be accomplished with a wide variety of devices, including but not limited to U.S. Pat. Nos. 5,735,814, 5,814,014, and 6,042,579, all of which are incorporated herein by reference. Using the teachings described herein, those of skill in the art will recognize that these and other devices and systems can be suitable for delivery of compositions comprising the synthetic, modified RNAs described herein.

In some such embodiments, the delivery system further comprises implanting a pump outside the body, the pump coupled to a proximal end of the catheter, and operating the pump to deliver the predetermined dosage of a composition comprising a synthetic, modified RNA described herein through the discharge portion of the catheter. A further embodiment comprises periodically refreshing a supply of the composition comprising a synthetic, modified RNA to the pump outside the body.

A synthetic, modified RNA can be administered ocularly, such as to treat retinal disorders, e.g., a retinopathy. For example, the pharmaceutical compositions can be applied to the surface of the eye or nearby tissue, e.g., the inside of the eyelid. They can be applied topically, e.g., by spraying, in drops, as an eyewash, or an ointment. Ointments or droppable liquids can be delivered by ocular delivery systems known in the art, such as applicators or eye droppers. Such compositions can include mucomimetics such as hyaluronic acid, chondroitin sulfate, hydroxypropyl methylcellulose or poly (vinyl alcohol), preservatives such as sorbic acid, EDTA or benzylchronium chloride, and the usual quantities of diluents and/or carriers. The pharmaceutical composition can also be administered to the interior of the eye, and can be introduced by a needle or other delivery device which can introduce it to a selected area or structure. The composition containing the synthetic, modified RNA can also be applied via an ocular patch.

A synthetic, modified RNA can be administered by an oral or nasal delivery. For example, drugs administered through these membranes have a rapid onset of action, provide therapeutic plasma levels, avoid first pass effect of hepatic metabolism, and avoid exposure of the drug to the hostile gastrointestinal (GI) environment. Additional advantages include easy access to the membrane sites so that the drug can be applied, localized and removed easily.

Administration of a composition comprising a synthetic, modified RNA can be provided by the subject or by another person, e.g., a another caregiver. A caregiver can be any entity involved with providing care to the human: for example, a hospital, hospice, doctor's office, outpatient clinic; a healthcare worker such as a doctor, nurse, or other practitioner; or a spouse or guardian, such as a parent. The medication can be provided in measured doses or in a dispenser which delivers a metered dose.

Where cells expressing proteins encoded by synthetic, modified RNA as described herein are administered to treat a malignancy or disease or disorder, the dose of cells administered will also vary with the therapeutic approach. For example, where the cell expresses a death ligand targeting the tumor cell, the dosage of cells administered will vary with the mode of their administration, e.g., local or systemic (smaller doses are required for local), and with the size of the tumor being treated—generally more cells or more frequent administration is warranted for larger tumors versus smaller ones. The amount of cells administered will also vary with the level of expression of the polypeptide or polypeptides encoded by the modified RNA—this is equally true of the administration of cells expressing proteins encoded by modified RNA for any purpose described herein. An important advantage of the methods described herein is that where, for example, more than one factor or polypeptide is expressed from a modified RNA introduced to a cell, the relative dosage of the expressed proteins can be tuned in a straightforward manner by adjusting the relative amounts of the modified RNAs introduced to the cell or subject. This is in contrast to the difficulty of tuning the expression of even a single gene product in a cell transduced with a viral or even a plasmid vector.

Therapeutic compositions containing at least one synthetic, modified-NA can be conventionally administered in a unit dose. The term "unit dose" when used in reference to a therapeutic composition refers to physically discrete units suitable as unitary dosage for the subject, each unit containing a predetermined quantity of active material calculated to produce the desired therapeutic effect in association with the required physiologically acceptable diluent, i.e., carrier, or vehicle.

The compositions are administered in a manner compatible with the dosage formulation, and in a therapeutically effective amount. The quantity to be administered and timing depends on the subject to be treated, capacity of the subject's system to utilize the active ingredient, and degree of therapeutic effect desired.

Pharmaceutical Compositions

The present invention involves therapeutic compositions useful for practicing the therapeutic methods described herein. Therapeutic compositions contain a physiologically tolerable carrier together with an active compound (synthetic, modified RNA, a cell transfected with a synthetic, modified RNA, or a cell differentiated, de-differentiated or transdifferentiated with a synthetic, modified RNA) as described herein, dissolved or dispersed therein as an active ingredient. In a preferred embodiment, the therapeutic composition is not immunogenic when administered to a mammal or human patient for therapeutic purposes, unless so desired. As used herein, the terms "pharmaceutically acceptable," "physiologically tolerable," and grammatical variations thereof, as they refer to compositions, carriers, diluents and reagents, are used interchangeably and represent that the materials are capable of administration to or upon a mammal without the production of undesirable or unacceptable physiological effects such as toxicity, nausea, dizziness, gastric upset, immune reaction and the like. A pharmaceutically acceptable carrier will not promote the raising of an immune response to an agent with which it is admixed, unless so desired. The preparation of a pharmacological composition that contains active ingredients dissolved or dispersed therein is well understood in the art and need not be limited based on formulation. Typically such compositions are prepared as injectable either as liquid solutions or suspensions, however, particularly where synthetic, modified RNA itself is administered, solid forms suitable for solution, or suspensions, in liquid prior to use can also be prepared. The preparation can also be emulsified or presented as a liposome composition. The active ingredient can be mixed with excipients which are pharmaceutically acceptable and compatible with the active ingredient and in amounts suitable for use in the therapeutic methods described herein. Suitable excipients are, for example, water, saline, dextrose, glycerol, ethanol or the like and combinations thereof. In addition, if desired, the composition can contain minor amounts of auxiliary substances such as wetting or emulsifying agents, pH buffering agents and the like which enhance the effectiveness of the active ingredient. Physiologically tolerable carriers are well known in the art. Exemplary liquid carriers are sterile aqueous solutions that contain no materials in addition to the active ingredients and water, or contain a buffer such as sodium phosphate at physiological pH value, physiological saline or both, such as phosphate-buffered saline. Saline-based carriers are most useful for the administration of cells or cell preparations. Still further, aqueous carriers can contain more than one buffer salt, as well as salts such as sodium and potassium chlorides, dextrose, polyethylene glycol and other solutes.

Kits

Provided herein are kits comprising synthetic, modified RNAs as described herein and kits for preparing such synthetic, modified RNAs.

Provided herein, in some aspects, are kits for altering the phenotype or the developmental potential of a cell, and comprise (a) a synthetic, modified RNA composition comprising at least one synthetic, modified RNA molecule comprising: (i) a 5' cap, (ii) an open reading frame encoding a polypeptide, and (iii) at least one modified nucleoside, and (b) packaging and instructions therefor.

In one embodiment of this aspect, the synthetic, modified RNA composition can further comprise a 3' untranslated region (e.g., murine alpha-globin 3' untranslated region) to enhance the stability of the synthetic, modified RNA. In another embodiment of this aspect, the 5' cap is a 5' cap analog such as e.g., a 5' diguanosine cap, tetraphosphate cap analogs having a methylene-bis(phosphonate) moiety (see e.g., Rydzik, A M et al., (2009) Org Biomol Chem 7(22):4763-76), dinucleotide cap analogs having a phosphorothioate modification (see e.g., Kowalska, J. et al., (2008) RNA 14(6):1119-1131), cap analogs having a sulfur substitution for a non-bridging oxygen (see e.g., Grudzien-Nogalska, E. et al., (2007) RNA 13(10): 1745-1755), N7-benzylated dinucleoside tetraphosphate analogs (see e.g., Grudzien, E. et al., (2004) RNA 10(9):1479-1487), or anti-reverse cap analogs (see e.g., Jemielity, J. et al., (2003) RNA 9(9): 1108-1122 and Stepinski, J. et al., (2001) RNA 7(10):1486-1495).

In other embodiments, the kit can further comprise materials for further reducing the innate immune response of a cell. For example, the kit can further comprise a soluble interferon receptor, such as B18R. The synthetic, modified RNAs provided in such a kit can encode for a polypeptide to express a transcription factor, a targeting moiety, a cell type-specific polypeptide, a cell-surface polypeptide, a differentiation factor, a reprogramming factor or a de-differentiation factor. The synthetic, modified RNA can be provided such that the synthetic, modified RNA is dephosphorylated, lacks a 5' phosphate, comprises a 5' monophosphate, or lacks a 5' triphosphate.

In some embodiments, the kit can comprise a plurality of different synthetic, modified RNA molecules.

In some aspects, the kit can be provided to induce reprogramming of a somatic cell to an induced pluripotent stem cell. Such kits include synthetic, modified RNAs encoding Oct4, Klf4, Sox2, or MYC. In some embodiments, the kits further comprise a synthetic, modified RNAs encoding LIN-28. The kit can provide the synthetic, modified RNAs in an admixture or as separate RNA aliquots.

The kit can further comprise an agent to enhance efficiency of reprogramming (e.g., valproic acid). The kit can further comprise one or more antibodies or primer reagents to detect a cell-type specific marker to identify reprogrammed cells.

Also provided herein are kits for preparing a synthetic, modified RNA. The kit comprises at least one modified nucleoside, such as 5'-methylcytidine or pseudouridine and an RNA polymerase. The kit can also comprise a 5' cap analog. The kit can also comprise a phosphatase enzyme (e.g., Calf intestinal phosphatase) to remove the 5' triphosphate during the RNA modification procedure. The kit can also comprise one or more templates for the generation of a synthetic, modified-RNA.

In one aspect, provided herein are kits comprising: (a) a container or vial with at least one synthetic, modified RNA molecule comprising at least two modified nucleosides, and (b) packaging and instructions therefor. Optionally, the kit can comprise one or more control synthetic, modified RNAs, such as a synthetic, modified RNA encoding green fluorescent protein (GFP) or other marker molecule. In some embodiments of this aspect, the at least two modified nucleosides are selected from the group consisting of 5-methylcytidine (5mC), N6-methyladenosine (m6A), 3,2'-O-dimethyluridine (m4U), 2-thiouridine (s2U), 2' fluorouridine, pseudouridine, 2'-O-methyluridine (Um), 2' deoxy uridine (2' dU), 4-thiouridine (s4U), 5-methyluridine (m5U), 2'-O-methyladenosine (m6A), N6,2'-O-dimethyladenosine (m6Am), N6,N6,2'-O-trimethyladenosine (m62Am), 2'-O-methylcytidine (Cm), 7-methylguanosine (m7G), 2'-O-methylguanosine (Gm), N2,7-dimethylguanosine (m2,7G), N2,N2,7-trimethylguanosine (m2,2,7G), and inosine (I). In some embodiments of this aspect, the at least two modified nucleosides are 5-methylcytidine (5mC) and pseudouridine.

In some embodiments of this aspect, the container with at least one synthetic, modified RNA molecule comprising at least two modified nucleosides further comprises a buffer. In some such embodiments, the buffer is RNase-free TE buffer at pH 7.0. In some embodiments of this aspect, the kit further comprises a container with cell culture medium.

In some embodiments of this aspect, the at least one synthetic, modified RNA encodes a developmental potential altering factor. In some such embodiments, the developmental potential altering factor is a reprogramming factor, a differentiation factor, or a de-differentiation factor.

In some embodiments of this aspect, the kit further comprises a container or vial comprising IFN inhibitor. In some embodiments of this aspect, the kit further comprises a container or vial valproic acid.

In some embodiments of this aspect, the synthetic, modified RNA encoding a reprogramming factor in the vial or container has a concentration of 100 ng/µl.

In some embodiments of this aspect, the reprogramming factor is selected from the group consisting of: OCT4 (SEQ ID NO: 788), SOX1, SOX 2 (SEQ ID NO: 941 or SEQ ID NO: 1501), SOX 3, SOX15, SOX 18, NANOG, KLF1, KLF 2, KLF 4 (SEQ ID NO: 501), KLF 5, NR5A2, c-MYC (SEQ ID NO: 636), 1-MYC, n-MYC, REM2, TERT, and LIN28 (SEQ ID NO: 524). In some such embodiments, the kit comprises at least three of the reprogramming factors selected from the group consisting of OCT4, SOX1, SOX 2, SOX 3, SOX15, SOX 18, NANOG, KLF1, KLF 2, KLF 4, KLF 5, NR5A2, c-MYC, 1-MYC, n-MYC, REM2, TERT, and LIN28. In some embodiments, the kit does not comprise a synthetic, modified RNA encoding c-MYC.

In some embodiments of those aspects where the kit is provided to induce reprogramming of a somatic cell to an induced pluripotent stem cell, the kit comprises: a vial comprising a synthetic, modified RNA encoding OCT4 and a buffer; a vial comprising a synthetic, modified RNA encoding SOX2 and a buffer; a vial comprising a synthetic, modified RNA encoding c-MYC and a buffer; and a vial comprising a synthetic, modified RNA encoding KLF4 and a buffer. In some such embodiments, the concentration of each reprogramming factor in the vial is 100 ng/µl. In some embodiments, the at least two modified nucleosides are pseudouridine and 5-methylcytodine. In some embodiments, OCT4 is provided in the kit in a molar excess of about three times the concentration of KLF4, SOX-2, and c-MYC in the kit. In some such embodiments, the kit further comprises a vial comprising a synthetic, modified RNA molecule encoding LIN28 and a buffer. In some such embodiments, the buffer is RNase-free TE buffer at pH 7.0. In some embodiments, the kit further comprises a synthetic, modified RNA encoding a positive control molecule, such as GFP.

For example, in one embodiment of those aspects where the kit is provided to induce reprogramming of a somatic cell to an induced pluripotent stem cell, the kit comprises: a vial comprising a synthetic, modified RNA encoding OCT4 and a buffer; a vial comprising a synthetic, modified RNA encoding SOX2 and a buffer; a vial comprising a synthetic, modified RNA encoding c-MYC and a buffer; a vial comprising a synthetic, modified RNA encoding KLF4 and a buffer; a vial comprising a synthetic, modified RNA molecule encoding LIN28 and a buffer; a vial comprising a synthetic, modified RNA encoding a positive control GFP molecule; and packaging and instructions therefor; where the concentration of the synthetic, modified RNAs encoding OCT4, SOX2, c-MYC, KLF-4, LIN28 and GFP in each of the said vials is 100 ng/µl, wherein the buffers in each of said vials is RNase-free TE buffer at pH 7.0; and wherein the synthetic, modified RNAs encoding OCT4, SOX2, c-MYC, KLF-4, LIN28 and GFP all comprise pseudouridine and 5-methylcytidine nucleoside modifications.

In other embodiments of those aspects where the kit is provided to induce reprogramming of a somatic cell to an induced pluripotent stem cell, the kit comprises: a single container or vial comprising all the synthetic, modified RNAs provided in the kit. In some such embodiments, the kit comprises a single vial or single container comprising: a synthetic, modified RNA encoding OCT4; a synthetic, modified RNA encoding SOX2; a synthetic, modified RNA encoding c-MYC; a synthetic, modified RNA encoding KLF4; and a buffer. In some such embodiments, the buffer is RNase-free TE buffer at pH 7.0. In some such embodiments, the total concentration of reprogramming factors in the vial is 100 ng/µl. In some embodiments, the at least two modified nucleosides are pseudouridine and 5-methylcytodine. In some such embodiments, OCT4 is provided in the vial or container in a molar excess of about three times the concentration of KLF4, SOX-2, and c-MYC in the vial or container. In some such embodiments, the vial or container further comprises a synthetic, modified RNA molecule encoding LIN28. In some such embodiments, the buffer is RNase-free TE buffer at pH 7.0. In some embodiments, the kit further comprises a synthetic, modified RNA encoding a positive control molecule, such as GFP.

In some embodiments, the kits provided herein comprise at least one synthetic, modified RNA further comprising a 5' cap. In some such embodiments, the 5' cap is a 5' cap analog. In some such embodiments, the 5' cap analog is a 5' diguanosine cap.

In some embodiments, t the kits provided herein comprise at least one synthetic, modified RNA that does not comprise a 5' triphosphate.

In some embodiments, the kits provided herein comprise at least one synthetic and modified RNA further comprising a poly(A) tail, a Kozak sequence, a 3' untranslated region, a 5' untranslated regions, or any combination thereof. In some such embodiments, the poly(A) tail, the Kozak sequence, the 3' untranslated region, the 5' untranslated region, or the any combination thereof, comprises one or more modified nucleosides.

All kits described herein can further comprise a buffer, a cell culture medium, a transfection medium and/or a media supplement. In preferred embodiments, the buffers, cell culture mediums, transfection mediums, and/or media supplements are RNase-free. In some embodiments, the synthetic, modified RNAs provided in the kits can be in a non-solution form of specific quantity or mass, e.g., 20 µg, such as a lyophilized powder form, such that the end-user adds a suitable amount of buffer or medium to bring the synthetic, modified RNAs to a desired concentration, e.g., 100 ng/µl.

All kits described herein can further comprise devices to facilitate single-administration or repeated or frequent infusions of a synthetic, modified RNA, such as a non-implantable delivery device, e.g., needle, syringe, pen device, or an implantatable delivery device, e.g., a pump, semi-permanent stent (e.g., intravenous, intraperitoneal, intracisternal or intracapsular), or reservoir. In some such embodiments, the delivery device can include a mechanism to dispense a unit dose of a composition comprising a synthetic, modified RNA. In some embodiments, the device releases the composition comprising a synthetic, modified RNA continuously, e.g., by diffusion. In some embodiments, the device can include a sensor that monitors a parameter within a subject. For example, the device can include pump, e.g., and, optionally, associated electronics.

Screening Methods

The ability to safely and efficiently reprogram, differentiate, transdifferentiate cells using the synthetic, modified RNAs compositions and methods thereof described herein, as well as generate engineered tissues using such cells, compositions and methods, has high applicability for use in high-throughput screening technologies of disease model systems and assays for the characterization of candidate agents for identifying novel agents for use in the treatment of human disease. Such screening methods and platforms can be used, for example, to identify novel agents for treating a desired disorder; to identify novel agents involved in reprogramming and differentiation, and/or alteration/maintenance of developmental states; or to identify effects of a candidate agent on one or more parameters of a particular cell type or engineered tissue generated using the compositions and methods described herein. Characterization of candidate agents can include aspects such as compound development, identifying cell-specific toxicity and cell-specific survival, and assessments of compound safety, compound efficacy, and dose-response parameters. For example, an engineered myocardium tissue can be contacted with a test agent, and the effect, if any, of the test agent on a parameter, such as an electrophysiological parameter, associated with normal or abnormal myocardium function, such as contractibility, including frequency and force of contraction, can be determined, or e.g., whether the agent has a cardiotoxic effect.

The drug discovery process is time-consuming and costly, in part owing to the high rate of attrition of compounds in clinical trials. Thus, modifications and alternative platforms that could accelerate the advancement of promising drug candidates, or reduce the likelihood of failure, would be extremely valuable. High-throughput screening technologies refer to the platforms and assays used to rapidly test thousands of compounds. For example, reporter systems used in cell lines can be used to assess whether compounds activate particular signaling pathways of interest.

The compositions and methods using synthetic, modified RNAs for reprogramming, differentiating, and transdifferentiating cells, as well as generating engineered tissues, described herein provide a reliable source of cells that can be generated and expanded in an efficient manner to quantities necessary for drug screening and toxicology studies. Further, because the compositions and methods comprising synthetic, modified RNAs described herein minimize the cellular interferon responses, and do not result in permanent genome modifications, the effects of a candidate agent can be studied with minimal confounding factors. As has been described herein, cells can be differentiated to generate specific cell types (for example, neurons, blood cells, pancreatic islet cells, muscle cells, and cardiomyocytes), and induced pluripotent stem cells can be generated from patients with specific diseases, such as, for example, a patient with cystic fibrosis, as demonstrated herein.

One particular advantage of cells and engineered tissues generated using the compositions, methods, and kits comprising synthetic, modified RNAs described herein for use in screening platforms, is that from a single and potentially limitless starting source, most of the major cells within the human body that could be affected by a drug or other agent can be produced. Such cells provide a better predictive model of both drug efficacy and toxicity than rodent cell lines or immortalized human cell lines that are currently used in high-throughput screens. While such immortalized cell and animal models have contributed a wealth of information about the complexity of various disease processes, compounds that show a significant benefit in such models can fail to show effectiveness in clinical trials. For example, use of a transgenic mouse that overexpresses mutant superoxide dismutase (SOD), a gene found to be associated with amyotrophic lateral sclerosis, enabled the identification of several compounds that alter disease characteristics, including vitamin E and creatine. However, when these compounds were tested in humans, no clinical improvements were observed (A. D. Ebert and C. N. Svendsen, "Human stem cells and drug screening: opportunities and challenges." 2010 Nature Reviews Drug Discovery 9, p. 1-6). Furthermore, toxic effects of compounds are often missed in cell and animal models due to specific interactions with human biological processes that cannot be recapitulated in these systems.

Accordingly, in some aspects, the compositions comprising synthetic, modified RNAs, and the methods described herein, can be used for evaluating the effects of novel candidate agents and compounds on specific human cell types that are relevant to drug toxicity effects. In some embodiments, cells can be induced to undergo differentiation to a particular cell type or tissue, using the synthetic, modified RNAs described herein, that the test drug or compound is discovered or known to affect, and then used for performing dose-response toxicity studies. In such embodiments, human stem cells, such as iPS cells, derived from patients can be exposed to appropriate differentiation factors using the compositions and methods comprising synthetic, modified RNAs described herein, and instructed to form the various cell types found in the human body, which could then be useful for assessing multiple cellular parameters and characteristics upon exposure to a candidate agent or compound. For example, the cells could be used to assess the effects of drug candidates on functional cardiomyocytes, or on cardiomyocytes having a specific genetic mutation, because drug development is often stalled by adverse cardiac effects. Thus, measurable disruption of electrophysiological properties by known and novel agents and compounds can be assessed in a clinically relevant, consistent, and renewable cell source. Also, for example, such cells can be used to identify metabolic biomarkers in neural tissues derived from human stem cells after toxin exposure. Such embodiments allow potentially toxic compounds to be eliminated at an early stage of the drug discovery process, allowing efforts to be directed to more promising candidates. As another example, islet cells generated using the methods and compositions comprising synthetic, modified RNAs described herein can be used to screen candidate agents (such as solvents, small molecule drugs, peptides, polynucleotides) or environmental conditions (such as culture conditions or manipulation) that affect the characteristics of islet precursor cells and their various progeny. For example, islet cell clusters or homogeneous β cell preparations can be tested for the effect of candidate agents, such as small molecule drugs, that have the potential to up- or down-regulate insulin synthesis or secretion. The cells are combined with the candidate agent, and then monitored for change in expression or secretion rate of insulin, using, for example, RT-PCR or immunoassay of the culture medium.

In other aspects, the compositions comprising synthetic, modified RNAs, and the methods thereof described herein, are used in differentiation screens, i.e., for identifying compounds that increase self-renewal or differentiation, promote maturation, or enhance cell survival of cells, such as stem cells, differentiated cells, or cancer cells.

In other aspects, the compositions comprising the synthetic, modified RNAs, and the methods thereof, described herein, can be used to screen for drugs that may correct an observed disease phenotype. In such aspects, cells can be expanded, differentiated into the desired cell type using synthetic, modified RNAs, and then used to screen for drugs that may correct the observed disease phenotype. A candidate agent or drug can be used to directly contact the surface of a reprogrammed, differentiated, transdifferentiated cell population, or engineered tissue by applying the candidate agent to a media surrounding the cell or engineered tissue. Alternatively, a candidate agent can be intracellular as a result of introduction of the candidate agent into a cell.

As used herein, "cellular parameters" refer to quantifiable components of cells or engineered tissues, particularly components that can be accurately measured, most desirably in a high-throughput system. A cellular parameter can be any measurable parameter related to a phenotype, function, or behavior of a cell or engineered tissue. Such cellular parameters include, changes in characteristics and markers of a cell or cell population, including but not limited to changes in viability, cell growth, expression of one or more or a combination of markers, such as cell surface determinants, such as receptors, proteins, including conformational or posttranslational modification thereof, lipids, carbohydrates, organic or inorganic molecules, nucleic acids, e.g. mRNA, DNA, global gene expression patterns, etc. Such cellular parameters can be measured using any of a variety of assays known to one of skill in the art. For example, viability and cell growth can be measured by assays such as Trypan blue exclusion, CFSE dilution, and $^3$H incorporation. Expression of protein or polyeptide markers can be measured, for example, using flow cytometric assays, Western blot techniques, or microscopy methods. Gene expression profiles can be assayed, for example, using microarray methodologies and quantitative or semi-quantitiative real-time PCR assays. A cellular parameter can also refer to a functional parameter, such as a metabolic parameter (e.g., expression or secretion of a hormone, such as insulin or glucagon, or an enzyme, such as carboxypeptidase), an electrophysiological parameter (e.g., contractibility, such as frequency and force of mechanical contraction of a muscle cell; action potentials; conduction, such as conduction velocity), or an immunomodulatory parameter (e.g., expression or secretion of a cytokine or chemokine, such as an interferon, or an interleukin; expression or secretion of an antibody; expression or secretion of a cytotoxin, such as perforin, a granzyme, and granulysin; and phagocytosis).

The "candidate agent" used in the screening methods described herein can be selected from a group of a chemical, small molecule, chemical entity, nucleic acid sequences, an action; nucleic acid analogues or protein or polypeptide or analogue of fragment thereof. In some embodiments, the nucleic acid is DNA or RNA, and nucleic acid analogues, for example can be PNA, pcPNA and LNA. A nucleic acid may be single or double stranded, and can be selected from a group comprising; nucleic acid encoding a protein of interest, oligonucleotides, PNA, etc. Such nucleic acid sequences include, for example, but not limited to, nucleic acid sequence encoding proteins that act as transcriptional repressors, anti-sense molecules, ribozymes, small inhibitory nucleic acid sequences, for example but not limited to RNAi, shRNAi, siRNA, micro RNAi (mRNAi), antisense oligonucleotides etc. A protein and/or peptide agent or fragment thereof, can be any protein of interest, for example, but not limited to; mutated proteins; therapeutic proteins; truncated proteins, wherein the protein is normally absent or expressed at lower levels in the cell. Proteins of interest can be selected from a group comprising; mutated proteins, genetically engineered proteins, peptides, synthetic peptides, recombinant proteins, chimeric proteins, antibodies, humanized proteins, humanized antibodies, chimeric antibodies, modified proteins and fragments thereof. A candidate agent also includes any chemical, entity or moiety, including without limitation synthetic and naturally-occurring non-proteinaceous entities. In certain embodiments, the candidate agent is a small molecule having a chemical moiety. Such chemical moieties can include, for example, unsubstituted or substituted alkyl, aromatic, or heterocyclyl moieties and typically include at least an amine, carbonyl, hydroxyl or carboxyl group, frequently at least two of the functional chemical groups, including macrolides, leptomycins and related natural products or analogues thereof. Candidate agents can be known to have a desired activity and/or property, or can be selected from a library of diverse compounds.

Also included as candidate agents are pharmacologically active drugs, genetically active molecules, etc. Such candidate agents of interest include, for example, chemotherapeutic agents, hormones or hormone antagonists, growth factors or recombinant growth factors and fragments and variants thereof. Exemplary of pharmaceutical agents suitable for use with the screening methods described herein are those described in, "The Pharmacological Basis of Therapeutics," Goodman and Gilman, McGraw-Hill, New York, N.Y., (1996), Ninth edition, under the sections: Water, Salts and Ions; Drugs Affecting Renal Function and Electrolyte Metabolism; Drugs Affecting Gastrointestinal Function; Chemotherapy of Microbial Diseases; Chemotherapy of Neoplastic Diseases; Drugs Acting on Blood-Forming organs; Hormones and Hormone Antagonists; Vitamins, Dermatology; and Toxicology, all of which are incorporated herein by reference in their entireties. Also included are toxins, and biological and chemical warfare agents, for example see Somani, S. M. (Ed.), "Chemical Warfare Agents," Academic Press, New York, 1992), the contents of which is herein incorporated in its entirety by reference.

Candidate agents, such as chemical compounds, can be obtained from a wide variety of sources including libraries of synthetic or natural compounds. For example, numerous means are available for random and directed synthesis of a wide variety of organic compounds, including biomolecules, including expression of randomized oligonucleotides and oligopeptides. Alternatively, libraries of natural compounds in the form of bacterial, fungal, plant and animal extracts are available or readily produced. Additionally, natural or synthetically produced libraries and compounds are readily modified through conventional chemical, physical and biochemical means, and may be used to produce combinatorial libraries. Known pharmacological agents may be subjected to directed or random chemical modifications, such as acylation, alkylation, esterification, amidification, etc. to produce structural analogs. Synthetic chemistry transformations and protecting group methodologies (protection and deprotection) useful in synthesizing the candidate compounds for use in the screening methods described herein are known in the art and include, for example, those such as described in R. Larock (1989) Comprehensive Organic Transformations, VCH Publishers; T. W. Greene and P. G. M. Wuts, Protective Groups in Organic Synthesis, 2nd ed., John Wiley and Sons (1991); L. Fieser and M. Fieser, Fieser and Fieser's Reagents for Organic Synthesis, John Wiley and Sons (1994); and L. Paquette, ed., Encyclopedia of Reagents for Organic Synthesis, John Wiley and Sons (1995), and subsequent editions thereof, the contents of each of which are herein incoporated in their entireties by reference.

Examples of methods for the synthesis of molecular libraries can be found in the art, for example in: DeWitt et al. (1993) Proc. Natl. Acad. Sci. U.S.A. 90:6909; Erb et al. (1994) Proc. Natl. Acad. Sci. USA 91:11422; Zuckermann et al. (1994) J. Med. Chem. 37:2678; Cho et al. (1993) Science 261:1303; Carrell et al. (1994) Angew. Chem. Int. Ed. Engl. 33:2059; Carell et al (1994) Angew. Chem. Int. Ed. Engl. 33:2061; and Gallop et al. (1994) J. Med. Chem. 37:1233, the contents of each of which are herein incoporated in their entireties by reference.

Libraries of candidate agents can be presented in solution (e.g., Houghten (1992), Biotechniques 13:412-421), or on beads (Lam (1991), Nature 354:82-84), chips (Fodor (1993) Nature 364:555-556), bacteria (Ladner, U.S. Pat. No. 5,223,409), spores (Ladner U.S. Pat. No. 5,223,409), plasmids (Cull et al. (1992) Proc Natl Acad Sci USA 89:1865-1869) or on phage (Scott and Smith (1990) Science 249:386-390; Devlin (1990) Science 249:404-406; Cwirla et al. (1990) Proc. Natl. Acad. Sci. 87:6378-6382; Felici (1991) J. Mol. Biol. 222: 301-310; Ladner supra.), the contents of each of which are herein incoporated in their entireties by reference.

Polypeptides to be Expressed

Essentially any polypeptide can be expressed using the synthetic, modified, RNAs described herein. Polypeptides useful with the methods described herein include, but are not limited to, transcription factors, targeting moieties and other cell-surface polypeptides, cell-type specific polypeptides, differentiation factors, death receptors, death receptor ligands, reprogramming factors, and/or de-differentiation factors.

Transcription Factors

In some embodiments, a synthetic, modified RNA or composition thereof encodes for a transcription factor. As used herein the term "transcription factor" refers to a protein that binds to specific DNA sequences and thereby controls the transfer (or transcription) of genetic information from DNA to mRNA. In one embodiment, the transcription factor encoded by the synthetic, modified RNA is a human transcription factor, such as those described in e.g., Messina D M, et al. (2004) Genome Res. 14(10B):2041-2047, which is herein incorporated by reference in its entirety.

Some non-limiting examples of human transcription factors (and their mRNA IDs and sequence identifiers) for use in the aspects and embodiments described herein include those listed herein in Table 1 (SEQ ID NOs: 1-1428 and 1483-1501).

TABLE 1

Exemplary Human Transcription Factors

| Gene Abbrev | ScriptSureID | mRNA ID | SEQ ID NO: | Class | Description |
|---|---|---|---|---|---|
| AA125825 | | AA125825 | 1 | Other | |
| AA634818 | | AA634818 | 2 | Other | |
| AATF | | NM_012138 | 3 | bZIP | apoptosis antagonizing transcription factor |
| AB002296 | NT_033233:4 | AB002296 | 4 | Bromodomain | |
| AB058701 | NT_025741:494 | AB058701 | 5 | ZnF-Other | |
| AB075831 | NT_011139:311 | AB075831 | 6 | ZnF-C2H2 | |
| ABT1 | | NM_013375 | 7 | Other | activator of basal transcription 1 |
| ADNP | | NM_015339 | 8 | Homeobox | activity-dependent neuroprotector |
| AEBP2 | NT_035211:21 | NM_153207 | 9 | ZnF-C2H2 | AE (adipocyte enhancer)-binding protein 2 |
| AF020591 | | NM_014480 | 10 | ZnF-C2H2 | zinc finger protein |
| AF0936808 | | NM_013242 | 11 | Other | similar to mouse Gir3 or D. melanogaster transcription factor IIB |
| AF5Q31 | | NM_014423 | 12 | Structural | ALL 1 fused gene from 5q31 |
| AHR | | NM_001621 | 13 | bHLH | aryl hydrocarbon receptor |
| AHRR | NT_034766:39 | NM_020731 | 14 | Co-repressor | aryl hydrocarbon receptor repressor |
| AI022870 | | AI022870 | 15 | Other | catalytic subunit of DNA polymerase zeta |
| AI352508 | | AI352508 | 16 | Other | Highly similar to DPOZ_HUMAN DNA POLYMERASE ZETA SUBUNIT |

TABLE 1-continued

Exemplary Human Transcription Factors

| Gene Abbrev | ScriptSureID | mRNA ID | SEQ ID NO: | Class | Description |
|---|---|---|---|---|---|
| AI569906 | | AI569906 | 17 | ZnF-C2H2 | Weakly similar to ZN42_HUMAN ZINC FINGER PROTEIN 42 |
| AIRE | | NM_000383 | 18 | ZnF-PHD | autoimmune regulator (autoimmune polyendocrinopathy candidiasis ectodermal dystrophy) |
| AK024238 | NT_023124:29 | AK024238 | 19 | Homeobox | |
| AK056369 | NT_034877:1 | AK056369 | 20 | ZnF-C2H2 | |
| AK057375 | NT_008389:5 | AK057375 | 21 | ZnF-C2H2 | |
| AK074366 | NT_005825:35 | AK074366 | 22 | ZnF-C2H2 | |
| AK074859 | NT_011150:41 | AK074859 | 23 | ZnF-C2H2 | |
| AK092811 | NT_017568:327 | AK092811 | 24 | ZnF-C2H2 | |
| AK096221 | NT_035560:44 | AK096221 | 25 | ZnF-C2H2 | |
| AK096288 | NT_007819:700 | AK096288 | 26 | ZnF-C2H2 | |
| AK098183 | NT_011104:165 | AK098183 | 27 | ZnF-C2H2 | |
| AK122874 | NT_011568:219 | AK122874 | 28 | ZnF-C2H2 | |
| AK126753 | NT_011176:418 | AK126753 | 29 | ZnF-C2H2 | |
| ANP32A | | NM_006305 | 30 | Co-activator | phosphoprotein 32 family, member A |
| APA1 | | NM_021188 | 31 | ZnF-C2H2 | ortholog of mouse another partner for ARF 1 |
| Apg4B | | NM_013325 | 32 | Other | Apg4/Au2 homolog 2 (yeast) |
| AR | | NM_000044 | 33 | NHR | androgen receptor (dihydrotestosterone receptor) |
| ARC | | NM_015193 | 34 | Other | activity-regulated cytoskeleton-associated protein |
| ARID1A | NT_028053:228 | NM_006015 | 35 | Structural | AT rich interactive domain 1A (SWI-like) |
| ARIH2 | | NM_006321 | 36 | ZnF-Other | ariedne (*drosophila*) homolog 2 |
| ARIX | | NM_005169 | 37 | Homeobox | aristaless homeobox |
| ARNT | | NM_001668 | 38 | bHLH | aryl hydrocarbon receptor nuclear translocator |
| ARNT2 | | NM_014862 | 39 | bHLH | aryl hydrocarbon receptor nuclear translocator 2 |
| ARNTL | | NM-001178 | 40 | bHLH | aryl hydrocarbon receptor nuclear translocator-like |
| ARNTL2 | NT_035213:171 | NM_020183 | 41 | bHLH | aryl hydrocarbon receptor nuclear translocator-like 2 |
| ARX | NT_025940:10 | NM_139058 | 42 | Homeobox | aristaless related homeobox |
| ASCL1 | | NM_004316 | 43 | bHLH | achaete-scute complex (*Drosophila*) homolog-like 1 |
| ASCL2 | | NM_005170 | 44 | bHLH | achaete-scute complex (*Drosophila*) homolog-like 2 |
| ASCL3 | | NM_020646 | 45 | bHLH | achaete-scute complex (*Drosophila*) homolog-like 3 |
| ASH1 | | NM-018489.2 | 46 | ZnF-PHD | hypothetical protein ASH1 |
| ASH2L | | NM_004674 | 47 | Structural | Ash2 (absent, small, or homeotic, *Drosophila*, homolog)-like |
| ATBF1 | | NM_006885 | 48 | ZnF-C2H2 | AT-binding transcription factor 1 |
| ATF1 | | NM_005171 | 49 | bZIP | activating transcription factor 1 |
| ATF2 | | NM_001880 | 50 | bZIP | activating transcription factor 2 |
| ATF3 | | NM_001674 | 51 | bZIP | activating transcription factor 3 |
| ATF4 | | NM_001675 | 52 | bZIP | Activating transcription factor 4 (tax-responsive enhancer element B67) |
| ATF5 | | NM_012068 | 53 | bZIP | activating transcripton factor 5 |
| ATF6 | | NM_007348 | 54 | bZip | activating transcription factor 6 |

TABLE 1-continued

Exemplary Human Transcription Factors

| Gene Abbrev | ScriptSureID | mRNA ID | SEQ ID NO: | Class | Description |
|---|---|---|---|---|---|
| AW875035 | | AW875035 | 55 | AnF-C2H2 | Moderately similar to YY1, Very very hypothetical protein RMSA-1 |
| AWP1 | | NM_019006 | 56 | ZnF-AN1 | protein associated with PRK1 |
| AY026053 | NT_011519:29 | AY026053 | 57 | Heat Shock | |
| BA044953 | NT_005825:31 | AB079778.1 | 1497 | | OSZF isoform; ras-responsive element binding protein (RREB-1) |
| | | U26914.1 | 1498 | | |
| BACH1 | | NM_001186 | 58 | bZIP | BTB and CNC homology 1, basic leucine zipper transcription factor 1 |
| BACH2 | | NM_021813 | 59 | bZIP | BTB and CNC homology 1, basic leucine zipper transcription factor 2 |
| BAGE2 | NT_029490:10 | NM_182482 | 60 | ZnF-PHD | B melanoma antigen family, member 2 |
| BANP | | NM_017869 | 61 | Co-activator | BANP homolog, SMAR1 homolog |
| BAPX1 | | NM_001189 | 62 | Homeobox | bagpipe homeobox (*Drosophila*) homolog 1 |
| BARHL1 | | NM_020064 | 63 | Homeobox | BarH (*Drosophila*)-like 1 |
| BARHL2 | | AJ251753 | 64 | Homeobox | BarH (*Drosophila*)-like 2 |
| BARX1 | | NM_021570 | 65 | Homeobox | BarH-like homeobox 1 |
| BARX2 | | NM_003658 | 66 | Homeobox | BarH-like homeobox 2 |
| BATF | | NM_006399.3 | 67 | bZIP | basic leucine zipper transcription factor, ATF-like |
| BAZ1A | | NM_013448 | 68 | Bromodomain | bromodomain adjacent to zinc finger domain, 1A |
| BAZ1B | | NM_023005 | 69 | Bromodomain | bromodomain adjacent to zinc finger domain, 1B |
| BAZ2A | | NM_013449 | 70 | Bromodomain | bromodomain adjacent to zinc finger domain, 2A |
| BAZ2B | | NM_013450.2 | 71 | Bromodomain | bromodomain adjacent to zinc finger domain, 2B |
| BCL11A | | NM_018014 | 72 | ZnF-C2H2 | B-cell CLL/lymphoma 11A (zinc finger protein) |
| BCL11B | | NM_022898 | 73 | ZnF-C2H2 | B-cell CLL/lymphoma 11B (zinc finger protein) |
| BHLHB3 | | NM_030762 | 74 | bHLH | basic helix-loop-helix domain containing, class B, 3 |
| BHLHB5 | | NM_152414 | 75 | bHLH | basic helix-loop-helix domain containing, class B, 5 |
| BIA2 | NT_029870:6 | NM_015431 | 76 | Co-activator | BIA2 protein |
| BIZF1 | | NM_003666 | 77 | bZIP | Basic leucine zipper nuclear factor 1 (JEM-1) |
| BMI1 | | NM_005180 | 78 | ZnF-Other | murine leukemia viral (bmii-1) oncogene homolog |
| BNC | | NM_001717 | 79 | Znf-C2H2 | basonuclin |
| BRD1 | | NM_014577 | 80 | Bromodomain | bromodomain-containing 1 |
| BRD2 | | NM_005104 | 81 | Bromodomain | bromodomain-containing 2 |
| BRD3 | | NM_007371 | 82 | Bromodomain | bromodomain-containing 3 |
| BRD4 | | NM_014299 | 83 | Bromodomain | bromodomain-containing 4 |
| BRD7 | | NM_013263 | 84 | Bromodomain | bromodomain-containing 7 |
| BRD9 | NT_034766:148 | NM_023924 | 85 | Bromodomain | bromodomain-containing 9 |
| BRDT | | NM_001726 | 86 | Bromodomain | Bromodomain, testis-specific |
| BRF1 | | NM_001519 | 87 | Other | BRF1 homolog, subunit of RNA polymerase III transcription initiation factor IIIB |
| BRF2 | | NM_006887 | 88 | ZnF-C3H | zinc finger protein 36, C3H type-like 2 |
| BRPF1 | | NM_004634 | 89 | Bromodomain | bromodomain and PHD finger containing, 1 |
| BRPF3 | | AB033112 | 90 | Bromodomain | bromodomain and PHD finger containing, 3 |
| BS69 | | NM_006624 | 91 | ZnF-NYND | Adenovirus 5 E1A binding protein |

TABLE 1-continued

Exemplary Human Transcription Factors

| Gene Abbrev | ScriptSureID | mRNA ID | SEQ ID NO: | Class | Description |
|---|---|---|---|---|---|
| BTAF1 | | AF038362 | 92 | Other | BTAF1 RNA polymerase II, B-TF11D transcription factor-associated, 170 kDa |
| BTBD1 | NT_019601:32 | NM_025238 | 93 | ZnF-BTB/POZ | BTB (POZ) domain containing 1 |
| BTBD14A | NT_019501:127 | NM_144653 | 94 | ZnF-BTB/POZ | BTB (POZ) domain containing 14A |
| BTBD14B | NT_031915:27 | NM_052876 | 95 | ZnF-BTB/POZ | BTB (POZ) domain containing 14B |
| BTBD2 | NT_011268:135 | NM_017797 | 96 | ZnF-BTB/POZ | BTB (POZ) domain containing 2 |
| BTBD3 | | NM_014962 | 97 | ZnF-BTB/POZ | BTB (POZ) domain containing 3 |
| BTBD4 | NT_033241:138 | AK023564 | 98 | ZnF-BTB/POZ | BTB (POZ) domain containing 4 |
| BTF3L2 | | M90355 | 99 | Other | basic transcription factor 3, like 2 |
| BTF3L3 | | N90356 | 100 | Other | Basic transcription factor 3, like 3 |
| BX538183 | NT_011109:1331 | BX538183 | 101 | ZnF-C2H2 | |
| BX548737 | NT_006802:14 | BX648737 | 102 | ZnF-C2H2 | |
| C11orf13 | | NM_003475 | 103 | Other | chromosome 11 open reading frame 13 |
| C11orf9 | | NM_013279 | 104 | Other | chromosome 11 open reading frame 9 |
| C14orf101 | | NM_017799 | 105 | Other | chromosome 14 open reading frame 101 |
| C14orf106 | | NM_018353 | 106 | Other | chromosome 14 open reading frame 106 |
| C14orf44 | NT_010422:242 | NM_024731 | 107 | ZnF-BTB/POZ | chromosome 16 open reading frame 44 |
| C1orf2 | | NM_006589 | 108 | Other | chromosome 10 open reading frame 2 |
| C20orf174 | | AL713683 | 109 | ZnF-C2H2 | chromosome 20 open reading frame174 |
| C21orf18 | | NM_017438 | 110 | Other | chromosome 21 open reading frame 18 |
| C31P1 | NT_034563:155 | NM_021633 | 111 | ZnF-BTB/POZ | kelch-like protein C31P1 |
| C5orf7 | | NM_016604 | 112 | Jumonji | chromosome 5 open reading frame 7 |
| CART1 | | NM_006982 | 113 | Homeobox | cartilage paired-class homeoprotein 1 |
| CBF2 | | NM_005760 | 114 | Beta-scaffold-CCAAT | CCAAT-box-binding transcription factor |
| CBFA2T1 | | NM_004349 | 115 | ZnF-MYND | core-binding factor, runt domain, alpha subunit 2; translocated to, 1; cyclin D-related |
| CBFA2T2 | NT_028392:284 | NM_005093 | 116 | ZnF-MYND | core-binding factor, runt domain, alpha subunit 2; translocated to, 2 |
| CBFA2T3 | | NM_005187 | 117 | ZnF-MYNC | Core-binding factor, runt domain, alpha subunit 2; translocated to, 3 |
| CBX1 | | NM_006807 | 118 | Structural | chromobox homolog 1 (*Drosophila* HP1 beta) |
| CBX2 | | X77824 | 119 | Structural | chromobox homolog 2 (*Drosophila* Pc class)) |
| CBX3 | | NM_007276 | 120 | Structural | chromobox homolog 3 (*Drosophila* HP1 gamma) |
| CBX4 | | NM_003655 | 121 | Structural | chromobox homolog 4 (*Drosophila* Pc class) |
| CBX5 | | NM_012117 | 122 | Structural | chromobox homolog 5 (*Drosophila* HP1 alpha) |
| CBX6 | | NM_014292 | 123 | Structural | chromobox homolog 6 |
| CBX7 | | NM_175709 | 124 | Structural | chromobox homolog 7a) |
| CDX1 | | NM_001804 | 125 | Homeobox | caudal-type homeobox transcription factor 1 |
| CDX2 | | NM_001265 | 126 | Homeobox | caudal-type homeobox transcription factor 2 |
| CDX4 | | NM_005193 | 127 | Homeobox | caudal-type homeobox transcription factor 4 |

TABLE 1-continued

Exemplary Human Transcription Factors

| Gene Abbrev | ScriptSureID | mRNA ID | SEQ ID NO: | Class | Description |
|---|---|---|---|---|---|
| CEBPA | | NM_004364 | 128 | bZIP | CCAA T/enhancer binding protein (C/EBP), alpha |
| CEBPB | | NM_005194 | 129 | bZIP | CCAA T/enhancer binding protein (C/EBP), beta |
| CEBPD | | NM_005195 | 130 | bZIP | CCAA T/enhancer binding protein (C/EBP), delta |
| CEBPE | | NM_001805 | 131 | bZIP | CCAA T/enhancer binding protein (C/EBP), epsilon |
| CEBPG | | NM_001806 | 132 | bZIP | CCAA T/enhancer binding protein (C/EBP), gamma |
| CECR6 | | Nm_031890 | 133 | Bromodomain | cat eye syndrome chromosome region, candidate 6 |
| CERD4 | | NM_012074 | 134 | ZnF-PHD | D4, zinc and double PHD fingers, family 3 |
| CEZANNE | | NM_020205 | 135 | Co-repressor | cellular zinc finger anti-NF-KappaB Cezanne |
| CG9879 | | A1217897 | | Other | CG9879 (fly) homolog |
| CGI-149 | | NM_016079 | 137 | Other | CGI-149 protein |
| CGI-85 | | NM_017635 | 138 | Structural | CGI-85 protein |
| CGI-99 | | NM_016039 | 139 | Other | CGI-99 protein |
| CHD1 | | NM_001270 | 140 | Structural | chromodomain helicase DNA binding protein 1 |
| CHD1L | | NM_024568 | 141 | Structural | chromodomain helicase DNA binding protein 1-like |
| CHD2 | | NM_001271 | 142 | Structural | chromodomain helicase DNA binding protein 2 |
| CHD3 | | NM_001272 | 143 | Structural | chromodomain helicase DNA binding protein 3 |
| CHD4 | | NM_001273 | 144 | Structural | chromodomain helicase DNA binding protein 4 |
| CHD5 | | NM_015557 | 145 | Structural | chromodomain helicase DNA binding protein 5 |
| CHD6 | | NM_032221 | 146 | Structural | chromodomain helicase DNA binding protein6 |
| CHES1 | | NM_005197 | 147 | Forkhead | checkpoint suppressor 1 |
| CHX10 | | XM_063425 | 148 | Homeobox | ceh-10 homeo domain containing homolog (C. elegans) |
| CIZ1 | NT_029366:585 | NM_012127 | 149 | ZnF-C2H2 | Cip1-interacting zinc finger protein |
| CLOCK | | NM_004898 | 150 | bHLH | Clock (mouse) homolog |
| CNOT3 | | NM_014516 | 151 | Other | CCRA-NOT transcription complex, subunit 3 |
| CNOT4 | | NM_013316 | 152 | Other | CCRA-NOT transcription complex, subunit 4 |
| CNOT8 | | NM_004779 | 153 | Other | CCRA-NOT transcription complex, subunit 8 |
| COPEB | | NM_001300 | 154 | ZnF-C2H2 | core promoter element binding protein |
| COPS5 | | NM_006837 | 155 | Co-activator | COP9 constitutive photomorphogenic homolog subunit 5 (*Arabidopsis*) |
| CORO1A | | NM_007074 | 156 | bZIP | coronin, actin-binding protein, 1A |
| CREB1 | | NM_004379 | 157 | bZIP | cAMP responsive element binding protein 1 |
| CREB3 | | NM_006468 | 158 | bZIP | cAMP responsive element binding protein 3 (luman) |
| CREB3L1 | | NM_052854 | 159 | bZIP | cAMP responsive element binding protein 3-like 1 |
| CREB3L2 | NT_007933:5606 | NM_194071 | 160 | bZIP | cAMP responsive element binding protein 3-like 2 |
| CREB3L3 | NT_011255:184 | NM_032607 | 161 | bZIP | cAMP responsive element binding protein 3-like 3 |
| CREB3L4 | NT_004858:17 | NM_130898 | 162 | bZIP | cAMP responsive element binding protein 3-like 4 |
| CREB5 | | NM_004904 | 163 | bZIP | cAMP responsive element binding protein 5 |
| CREBBP | | NM_004380 | 164 | ZnPHD | CREP binding protein (Rubinstein-Taybi syndrome) |

TABLE 1-continued

Exemplary Human Transcription Factors

| Gene Abbrev | ScriptSureID | mRNA ID | SEQ ID NO: | Class | Description |
|---|---|---|---|---|---|
| CREBL1 | | NM_004381 | 165 | bZIP | cAMP responsive element binding protein-like 1 |
| CREBL2 | | NM_001310 | 166 | bZIP | cAMP responsive element binding protein-like 2 |
| CREG | | NM_003851 | 167 | Other | Cellular repressor of EIA-stimulated genes |
| CREM | | NM_001881 | 168 | bZIP | cAMP responsive element modulator |
| CRIP1 | | NM_001311 | 169 | Co-activator | cysteine-rich protein 1 (intestinal) |
| CRIP2 | | NM_001312 | 170 | Co-activator | cysteine-rich protein 2 |
| CROC4 | | NM_006365 | 171 | Other | transcriptional activator of the c-fos promoter |
| CRSP8 | | NM_004269 | 172 | Co-activator | cofactor required for Sp1 transcriptional activation, subunit 8, 34 kD |
| CRSP9 | | NM_004270 | 173 | Co-activator | cofactor required for Sp1 transcriptional activation, subunit 9, 33 kD |
| CRX | | NM_000554 | 174 | Homeobox | cone-rod homeobox |
| CSDA | | NM_003651 | 175 | Beta-scaffold-cold-shock | cold shock domain protein A |
| CSEN | | NM_013434 | 176 | Other | Calsenilin, presenilin-binding protein, EF hand transcription factor |
| CSRP1 | | NM_004078 | 177 | Co-activator | cysteine and glycine-rich protein 1 |
| CSRP2 | | NM_001321 | 178 | Co-activator | cysteine and glycine-rich protein 2 |
| CSRP3 | | NM_003476 | 179 | Co-activator | cysteine and glycine-rich protein 3 (cardiac LIM protein) |
| CTCF | | NM_006565 | 180 | ZnF-C2H2 | CCCTC-binding factor (zinc finger protein) |
| CTCFL | NT_011362:1953 | NM_080618 | 181 | ZnF-C2H2 | CCCTC-binding factor (zinc finger protein)-like |
| CTNNB1 | | NM_001904 | 182 | Co-activator | catenin (cadherin-associated protein), beta 1, 88 kD |
| CUTL1 | | NM_001913 | 183 | Homeobox | cut (*Drosophila*)-like 1 (CCAAT displacement protein) |
| CUTL2 | | AB006631 | 184 | Homeobox | cut-like 2 (*Drosophila*)- |
| MAMLD1 | | NM_001177465.1 | 185 | Other | isoform 1 |
| | | NM_001177466.1 | 1483 | | isoform 2 |
| | | NM_005491.3 | 1484 | | isoform 3 |
| DACH | | NM_004392 | 186 | Co-repressor | dachshund (*Drosophila*) homolog |
| DAT1 | | NM_018640 | 187 | ZnF-Other | neuronal specific transcription factor DAT1 |
| DATF1 | | NM_022105 | 188 | ZnF-PHD | death associated transcription factor 1 |
| DBP | | NM_001352 | 189 | bZIP | D site of albumin promoter (albumin D-box) binding protein |
| DDIT3 | | NM_004083 | 190 | bZIP | DNA-damage-inducible transcript 3 |
| DEAF1 | | NM_021008 | 191 | ZnF-MYND | deformed epidermal autoregulatory factor 1 (*Drosophila*) |
| DKFZP434B0335 | | AB037779 | 192 | Other | DKFZP434B0335 protein |
| DKFZP434B195 | | NM_031284 | 193 | Other | Hypothetical protein DKFZp434B195 |
| DKFZp434G043 | | AL080134 | 194 | bHLH | HLHmdelta (fly) homolog |
| DKFZP434P1750 | | NM_015527 | 195 | | DKFZP434P1750 |
| DKFZp547B0714 | NT_011233:43 | NM_152606 | 196 | ZnF-C2H2 | Hypothetical protein DKFZp547B0714 |
| DLX2 | | NM_004405 | 197 | Homeobox | Distal-less homeobox 2 |
| DLX3 | | NM_005220 | 198 | Homeobox | distal-less homeobox 3 |
| DLX4 | | NM_001934 | 199 | Homeobox | distal-less homeobox 4 |
| DLX5 | | NM_005221 | 200 | Homeobox | distal-less homeobox 5 |
| DLX6 | | NM_005222 | 201 | Homeobox | distal-less homeobox 6 |
| DMRT1 | | NM_021951 | 202 | ZnF-DM | doublesex and mab-3 related transcription factor 1 |

TABLE 1-continued

Exemplary Human Transcription Factors

| Gene Abbrev | ScriptSureID | mRNA ID | SEQ ID NO: | Class | Description |
|---|---|---|---|---|---|
| DMRT2 | | NM_006557 | 203 | ZnF-DM | doublesex and mab-3 related transcription factor 2 |
| DMRT3 | NT_008413:158 | NM_021240 | 204 | ZnF-DM | doublesex and mab-3 related transcription factor 3 |
| DMRTA1 | NT_023974:296 | AJ290954 | 205 | ZnF-DM | DMRT-like family A1 |
| DMRTA2 | | AJ301580 | 206 | ZnF-DM | DMRT-like family A2 |
| DMRTB1 | NT_004424:223 | NM_033067 | 207 | ZnF-DM | DMRT-like family B with prolien-rich C-terminal, 1 |
| DMRTC1 | | BC029799 | 208 | ZnF-DM | DMRT-like family C1 |
| DMRTC2 | NT_011139:240 | NM_033052 | 209 | ZnF-DM | DMRT-like family C2 |
| DMTF1 | | NM_021145 | 210 | Other | cyclin D binding Nyb-like transcription factor 1 |
| DR1 | | NM_001938 | 211 | Co-repressor | down-regulator of transcription 1, TBP-binding (negative collector 2) |
| DRAP1 | | NM_006442 | 212 | Co repressor | DR1-associated protein 1 (negative cofactor 2 alpha) |
| DRIL1 | | NM_005224 | 213 | Structural | dead ringer (*Drosophila*)-like 1 |
| DRIL2 | | NM_006465 | 214 | Structural | dead ringer (*Drosophila*)-like 2 (bright and dead ringer) |
| DRPLA | | NM-001940 | 215 | Co-repressor | dentatorubral-palidoluysian atrophy (atrophin-1) |
| DSIPI | | NM-004089 | 216 | bZIP | delta sleep inducing peptide, immunoreactor |
| DTX2 | | AB040961 | 217 | ZnF-other | deltex homolog 2 (*Drosophila*) |
| DUX1 | | NM_012146 | 218 | Homeobox | double homeobox 1 |
| DUX2 | | NM_012147 | 219 | Homeobox | double homeobox 2 |
| DUX3 | | NM_012148 | 220 | Homeobox | double homeobox genes 3 |
| DUX4 | | NM_033178 | 221 | Homeobox | double homeobox 4 |
| DUX5 | | NM_012149 | 222 | Homeobox | double homeobox 5 |
| DXYS155E | | NM_005088 | 223 | Other | DNA segment on chromosome X and Y (unique) 155 expressed sequence |
| E2F1 Text cut off | | NM_005225 | 224 | E2F | E2F transcription factor 1 |
| EED | | NM_003797 | 225 | Structural | Embryonic echoderm development |
| EGLN1 | NT_004753:53 | NM_022051 | 226 | ZnF-MYND | egl nine homolog 1 (*C. elegans*) |
| EGLN2 | | NM_017555 | 227 | ZnF-MYND | egl nine homolog 2 (*C. elegans*) |
| EGR1 | | NM_001964 | 228 | ZnF-C2H2 | early growth response 1 |
| EGR2 | | NM_000399 | 229 | ZnF-C2H2 | early growth response 2 (Knox-20 (*Drosophila*) homolog) |
| EGR3 | | NM_004430 | 230 | ZnF-C2H2 | early growth response 3 |
| EGR4 | | NM_001965 | 231 | ZnF-C2H2 | early growth response 4 |
| EHF | | NM_012153 | 232 | Trp cluster-Ets | ets homologous factor |
| EHZF | NT_011044:150 | NM_015461 | 233 | ZnF-PHD | early hematopoietic zinc finger |
| ELD/OSA1 | | NM_020732 | 234 | Structural | BRG1-binding protein ELD/OSA1 |
| ELF1 | | M82882 | 235 | Trp cluster Ets | E-74-like factor 1 (ets domain transcription factor) |
| ELF2 | | NM_006874 | 236 | Trp cluster Ets | E-74-like factor 2 (ets domain transcription factor) |
| ELF3 | | NM_004433 | 237 | Trp cluster Ets | E-74-like factor 3 (ets domain transcription factor, epithelial-specific) |
| ELF4 | | NM_001421 | 238 | Trp cluster Ets | E-74-like factor 4 (ets domain transcription factor) |
| ELF5 | | NM_001422 | 239 | Trp cluster Ets | E-74-like factor 5 (ets domain transcription factor) |
| ELK1 | | NM_005229 | 240 | Trp cluster Ets | ELK1, member of ETS oncogene family |

TABLE 1-continued

Exemplary Human Transcription Factors

| Gene Abbrev | ScriptSureID | mRNA ID | SEQ ID NO: | Class | Description |
|---|---|---|---|---|---|
| ELK3 | | NM_005230 | 241 | Trp cluster Ets | ELK3, ETS-domain protein (SRF accessory protein 2) |
| ELK4 | | NM_021795 | 242 | Trp cluster Ets | ELK4, ETS-domain protein (SRF accessory protein 1) |
| EME2 | NT_010552:331 | AK074080 | 243 | ZnF-BTB/POZ | essential meiotic endonuclease I homolog 2 (*S. pombe*) |
| EMX1 | | X68879 | 244 | Homeobox | empty spiracles homolog 1 (*Drosophila*) |
| EMX2 | | NM_004098 | 245 | Homeobox | empty spiracles homolog 2 (*Drosophila*) |
| EN1 | | NM_001426 | 246 | Homeobox | engrailed homolog 1 |
| EN2 | | NM_001427 | 247 | Homeobox | engrailed homolog 2 |
| EC1 | NT_oo6713:275 | NM_003633 | 248 | ZnF-BTB/POZ | ectodermal-neural cortex (with BTB-like domain) |
| ENO1 | | NM_001428 | 249 | Other | enolase 1 |
| EOMES | | NM_005442 | 250 | T-box | Eomesodermin (*Xenopus laevis*) homolog |
| ERCC3 | | NM_000122 | 251 | Other | excision repair cross-complementing rodent repair deficiency, complementation group 3 |
| ERCC6 | | NM_000124 | 252 | Other | excision repair cross-complementing rodent repair deficiency, complementation group 6 |
| ERF | | NM_006494 | 253 | Trp cluster-Ets | Ets2 repressor factor |
| ERG | | NM_004449 | 254 | Trp cluster-Ets | v-ets avian erythroblastosis virus E26 oncogene related |
| ESR1 | | NM_000125 | 255 | NHR | estrogen receptor 1 |
| ESR2 | | NM_001437 | 256 | NHR | estrogen receptor 2 |
| ESRRA | | NM_004451 | 257 | NHR | estrogen-related receptor alpha |
| ESRRB | | NM_004452 | 258 | NHR | estrogen-related receptor beta |
| ESRRG | | NM_001438 | 259 | NHR | estrogen-related receptor gamma |
| ESXIL | NT_01165135 | NM_153448 | 260 | Homeobox | extraembryonic, spermatogenesis, homeobox 1-like |
| ETR101 | | NM_004907 | 261 | Other | immediate early protein |
| ETS1 | | NM_005238 | 262 | Trp cluster-Ets | v-ets avian erythroblastosis virus E26 oncogene homolog 1 |
| ETS2 | | NM_005239 | 263 | Trp cluster-Ets | v-ets avian erythroblastosis virus E26 oncogene homolog 2 |
| ETV1 | | NM_004956 | 264 | Trp cluster-Ets | ets variant gene 1 |
| ETV2 | | AF000671 | 265 | Trp cluster-Ets | ets variant gene 2 |
| ETV3 | | L16464 | 266 | Trp cluster-Ets | ets variant gene3 |
| ETV4 | | NM_001986 | 267 | Trp cluster-Ets | ets variant gene 4 (E1A enhancer-binding protein, E1AF) |
| ETV5 | | NM_004454 | 268 | Trp cluster-Ets | ets variant gene 5 (ets-related molecule) |
| ETV6 | | NM_001987 | 269 | Trp cluster-Ets | ets variant gene 6, TEL oncogene |
| EV11 | NT_034563:55 | NM_005241 | 270 | ZnF-C2H2 | ecotropic viral integration site 1 |
| EVX1 | | NM_001989 | 271 | Homeobox | eve, even-skipped homeo box homolog 1 (*Drosophila*) |
| EVX2 | | M59983 | 272 | Homeobox | eve, even-skipped homeo box homolog 2 (*Drosophila*) |
| EYA1 | | NM_000503 | 273 | Other | eyes absent (*Drosophila*) homolog 1 |

TABLE 1-continued

Exemplary Human Transcription Factors

| Gene Abbrev | ScriptSureID | mRNA ID | SEQ ID NO: | Class | Description |
|---|---|---|---|---|---|
| EYA2 | | NM_005204 | 274 | Other | eyes absent (*Drosophila*) homolog 2 |
| FBI1 | | NM_015898 | 275 | ZnF-BTB/POZ | short transcripts binding protein; lymphoma related factor |
| FEM1A | | AL359589 | 276 | Other | fem-1 homolog a (*C. elegans*) |
| FEZL | | NM_018008 | 277 | ZnF-C2H2 | likely ortholog of mouse and zebrafish forebrain embryonic zinc finger-like |
| FHL1 | | NM_001449 | 278 | ZnF-Other | four and a half LIM domains 1 |
| FHL2 | | NM_001450 | 279 | ZnF-Other | four and a half LIM domains 2 |
| FHL5 | | NM_020482 | 280 | Co-activator | four and a half LIM domains 5 |
| FHX | | NM_018416 | 281 | Forkhead | FOXJ2 forkhead factor |
| FKHL18 | | AF042831 | 282 | Forkhead | forkhead (*Drosophila*)-like 18 |
| FLI1 | | NM_002017 | 283 | Trp cluster-Ets | friend leukemia virus integration 1 |
| FMR2 | | NM_002025 | 284 | AF-4 | fragile X mental retardation 2 |
| FOS | | NM_005252 | 285 | bZIP | v-fos FBJ murine osteosarcoma viral oncogene homolog |
| FOSB | | NM_006732 | 286 | bZIP | FBJ murine osteosarcoma viral oncogene homolog B |
| FOSL1 | | NM_005438 | 287 | bZIP | FOS-like antigen 1 |
| FOSL2 | | NM_005253 | 288 | bZIP | FOS-like antigen 2 |
| FOXA1 | | NM_004496 | 289 | Forkhead | forkhead box A1 |
| FOXA2 | | NM_021784 | 290 | Forkhead | forehead box A2 |
| FOXE2 | | NM_012185 | 291 | Forkhead | forkhead box E2 |
| FOXE3 | | NM_012186 | 292 | Forkhead | forkhead box E3 |
| FOXF1 | | NM_001451 | 293 | Forkhead | forkhead box F1 |
| FOXF2 | | NM_001452 | 294 | Forkhead | forkhead box F2 |
| FOXG1B | | NM_005249 | 295 | Forkhead | forkhead box G1B |
| FOXH1 | | NM_003923 | 296 | Forkhead | forkhead box H1 |
| FOXI1 | | NM_012188 | 297 | Forkhead | forkhead box I1 |
| FOXJ1 | | NM_001454 | 298 | Forkhead | forkhead box J1 |
| FOXL1 | | NM_005250 | 299 | Forkhead | forkhead box L1 |
| FOXL2 | | NM_023067 | 300 | Forkhead | forkhead box L2 |
| FOXM1 | | NM_021953 | 301 | Forkhead | forkhead box M1 |
| FOXN4 | NT_009770:26 | AF425596 | 302 | Forkhead | forkhead/winged helix transcription factor FOXN4 |
| FOXO1A | | NM_002015 | 303 | Forkhead | forkhead box O1A (rhabdomyosarcoma) |
| FOXO3A | | NM_001455 | 304 | Forkhead | forkhead box O3A |
| FOXP1 | | AF275309 | 305 | Forkhead | forkhead box P1 |
| FOXP2 | | NM_014491 | 306 | Forkhead | forkhead box P2 |
| FOXP3 | | NM_014009 | 307 | Forkhead | forkhead box P3 |
| FOXP4 | NT_007592:3277 | NM_138457 | 308 | Forkhead | forkhead box P4 |
| FOXQ1 | | NM_033260 | 309 | Forkhead | forkhead box Q1 |
| FREQ | NT_029366:864 | NM_014286 | 310 | Other | frequenin homolog (*Drosophila*) |
| FUBP1 | | NM_003902 | 311 | Other | far upstream element-binding protein |
| FUBP3 | NT_008338:25 | BC001325 | 312 | Other | far upstream element (FUSE) binding protein 3 |
| GABPA | | NM_002040 | 313 | Trp cluster-Ets | GA-binding protein transcription factor, alpha subunit (60 kD) |
| GABPB1 | | NM_005254 | 314 | Co-activator | GA-binding protein transcription factor, beta subunit 1 (53 kD) |
| GABPB2 | | NM_016655 | 315 | Trp cluster-Ets | GA-binding protein transcription factor, beta subunit 2 (47 kD) |
| GAS41 | | NM_006530 | 316 | Structural | glioma-amplified sequence-41 |
| GASC1 | | AB018323 | 317 | ZnF-PHD | gene amplified in squamous cell carcinoma 1 |

TABLE 1-continued

Exemplary Human Transcription Factors

| Gene Abbrev | ScriptSureID | mRNA ID | SEQ ID NO: | Class | Description |
|---|---|---|---|---|---|
| GATA1 | | NM_002049 | 318 | ZnF-GATA | GATA-binding protein 1 (globin transcription factor 1) |
| GATA2 | | NM_002050 | 319 | ZnF-GATA | GATA-binding protein 2 |
| GATA3 | | NM_002051 | 320 | ZnF-GATA | GATA-binding protein 3 |
| GATA4 | | NM_002052 | 321 | ZnF-GATA | GATA-binding protein 4 |
| GATA5 | | NM_080473 | 322 | ZnF-GATA | GATA-binding protein 5 |
| GATA6 | | NM_005257 | 323 | ZnF-GATA | GATA-binding protein 6 |
| GBX1 | | L11239 | 324 | Homeobox | gastrulation brain homeobox 1 |
| GBX2 | | NM_001485 | 325 | Homeobox | gastrulation brain homeobox 2 |
| GFI1 | | NM_005263 | 326 | ZnF-C2H2 | growth factor independent 1 |
| GFI1B | | NM_004188 | 327 | ZnF-C2H2 | growth factor independent 1B (potential regulator of CDKN1A, translocated in CML) |
| GIOT-1 | | AB021641 | 328 | ZnF-C2H2 | gonadotropin inducible transcription repressor 1 |
| GIOT-2 | | NM_016264 | 329 | ZnF-C2H2 | gonadotropin inducible transcription repressor-2 |
| GL1 | | NM_005269 | 330 | ZnF-C2H2 | glioma-associated oncogene homolog (zinc finger protein) |
| GLI2 | | NM_005270 | 331 | ZnF-C2H2 | GLI-Kruppel family member GLI2 |
| GLI3 | | NM_000168 | 332 | ZnF-C2H2 | GLI-Kruppel family member GLI3 (Greig cephalopolysyndactyly syndrome) |
| GLI4 | NT_023684:15 | NM_138465 | 333 | ZnF-C2H2 | GLI-Kruppel family member GLI4 |
| GLIS2 | | NM_032575 | 334 | ZnF-C2H2 | Kruppel-like zinc finger protein GLIS2 |
| GREB1 | NT_005334:553 | NM_014668 | 335 | Co-repressor | GREB1 protein |
| GRLF1 | | NM_004491 | 336 | ZnF-Other | glucocorticoid receptor DNA binding factor 1 |
| GSC | | NM_173849.2 | 337 | Homeobox | goosecoid |
| GSCL | | NM_005315 | 338 | Homeobox | goosecoid-like |
| GSH1 | | XM_046853 | 339 | Homeobox | genomic screened homeo box 1 homolog (mouse) |
| GSH2 | | NM_133267 | 340 | Homeobox | genomic screened homeo box 2 homolog (mouse) |
| GTF2A1 | | NM_015859 | 341 | Other | general transcription factor IIA, 1 (37 kD and 19 kD subunits) |
| GTF2A2 | | NM_004492 | 342 | Other | general transcription factor IIA, 2 (12 kD subunit) |
| GTF2B | | NM_001514 | 343 | Other | general transcription factor IIB |
| GTF2E1 | | NM_005513 | 344 | Other | general transcription factor IIE, polypeptide 1 (alpha subunit, 56 kD) |
| GTF2E2 | | NM_002095 | 345 | Other | general transcription factor IIE, polypeptide 2 (beta subunit, 34 kD) |
| GTF2F1 | | NM_002096 | 346 | Other | general transcription factor IIF, polypeptide 1 (74 kD subunit) |
| GTF2F2 | | NM_004128 | 347 | Other | general transcription factor IIF, polypeptide 2 (30 kD subunit) |
| GTF2H1 | | NM_005316 | 348 | Other | general transcription factor IIH, polypeptide 1 (62 kD subunit) |
| GTF2IRD1 | NT_007758:1220 | NM_005685 | 349 | bHLH | GTF21 repeat domain containing 1 |
| GTF2IRD2 | NT_007758:1320 | NM_173537 | 350 | bHLH | transcription factor GTF2IRD2 |
| GTF3A | | NM_002097 | 351 | Other | general transcription factor IIIA |
| GTF3C1 | | NM_001520 | 352 | Other | general transcription factor IIIC, polypeptide 1 (alpha subunit, 220 kD) |

TABLE 1-continued

Exemplary Human Transcription Factors

| Gene Abbrev | ScriptSureID | mRNA ID | SEQ ID NO: | Class | Description |
|---|---|---|---|---|---|
| GTF3C2 | | NM_001521 | 353 | Other | general transcription factor IIIC, polypeptide 2 (beta subunit, 110 kD) |
| GTF3C3 | | NM_012086 | 354 | Other | general transcription factor IIIC, polypeptide 3 (102 kD) |
| GTF3C4 | | NM_012204 | 355 | Other | general transcription factor IIIC, polypeptide 4 (90 kD) |
| GTF3C5 | | NM_012087 | 356 | Other | general transcription factor IIIC, polypeptide 5 (63 kD) |
| HAND1 | | NM_004821 | 357 | bHLH | heart and neural crest derivatives expressed 1 |
| HAND2 | | NM_021973 | 358 | bHLH | basic helix-loop-helix transcription factor HAND2 |
| HATH6 | NT_015805:94 | NM_032827 | 359 | bHLH | basic helix-loop-helix transcription factor 6 |
| HBOA | | NM_007067 | 360 | Co-activator | histone acetyltransferase |
| HCF2 | | NM_013320 | 361 | Other | host cell factor 2 |
| HCNGP | | NM_013260 | 362 | Other | transcriptional regulator protein |
| HDAC1 | | NM_004964 | 363 | Co-repressor | histone deacetylase 1 |
| HDAC2 | | NM_001527 | 364 | Co-repressor | histone deacetylase 2 |
| HDAC4 | | NM_006037 | 365 | Co-repressor | histone deacetylase 4 |
| HDAC8 | NT-011594:18 | NM_018486 | 366 | Structural | histone deacetylase 8 |
| HES2 | | NM_019089 | 367 | bHLH | hairy and enhancer of split 2 (*Drosophila*) |
| HES5 | | BQ924744 | 368 | bHLH | hairy and enhancer of split 5 (*Drosophila*) |
| HES6 | | NM_018645 | 369 | bHLH | hairy and enhancer of split 6 (*Drosophila*) |
| HES7 | | NM_032580 | 370 | bHLH | hairy and enhancer of split 7 (*Drosophila*) |
| HESX1 | | NM_003865 | 371 | Homeobox | homeobox (expressed in ES cells) 1 |
| HEY1 | | NM_012258 | 372 | bHLH | hairy/enhancer-of-split related with YRPW motif 1 ('YRPW' disclosed as SEQ ID NO: 1482) |
| HEY2 | | NM_012259 | 373 | bHLH | hairy/enhancer-of-split related with YRPW motif 2 ('YRPW' disclosed as SEQ ID NO: 1482) |
| HEYL | | NM_014571 | 374 | bHLH | hairy/enhancer-of-split related with YRPW motif-life ('YRPW' disclosed as SEQ ID NO: 1482) |
| HHEX cutoff | | NM_002729 | 375 | Homeobox | hematopoietically expressed homeobox |
| HIVEP1 | | NM_002114 | 376 | ZnF-C2H2 | human immunodeficiency virus type I enhancer-binding protein 1 |
| HIVEP2 | | NM_006734 | 377 | ZnF-C2H2 | human immunodeficiency virus type I enhancer-binding protein 2 |
| HIVEP3 | NT_004852:421 | NM_024503 | 378 | ZnF-C2H2 | human immunodeficiency virus type 1 enhancer binding protein 3 |
| HKR1 | | BC004513 | 379 | ZnF-C2H2 | GLI-Kruppel family member HKR1 |
| HKR2 | | M20676 | 380 | ZnF-C2H2 | GL1-Kruppel family member HKR2 |
| HKR3 | | NM_005341 | 381 | ZnF-BTB/POZ | GLI-Kruppel family member HKR3 |
| HLF | | NM_002126 | 382 | bZIP | hepatic leukemia factor |
| HLX1 | | NM_021958 | 383 | Homeobox | H2.0 (*Drosophila*)-like homeo box 1 |
| HLXB9 | | NM_005515 | 384 | Homeobox | homeo box HB9 |
| HMG20A | NT_024654:319 | NM_018200 | 385 | Structural | high-mobility group 20A |
| HMG20B | | NM_006339 | 386 | Structural | high-mobility group 20B |
| HMGA1 | | NM_002131 | 387 | Beta-scaffold-HMG | high mobility group AT-hook 1 |

TABLE 1-continued

Exemplary Human Transcription Factors

| Gene Abbrev | ScriptSureID | mRNA ID | SEQ ID NO: | Class | Description |
|---|---|---|---|---|---|
| HMGA2 | | NM_003483 | 388 | Beta-scaffold-HMG | high mobility group AT-hook 2 |
| HMGB1 | | NM_002128 | 389 | Structural | high-mobility group box 1 |
| HMGB2 | | NM_002129 | 390 | Structural | high-mobility group box 2 |
| HMGB3 | NT_011602:55 | NM_005342 | 391 | Structural | high-mobility group box 3 |
| HMGN2 | | NM_005517 | 392 | Structural | high-mobility group nucleosomal binding domain 2 |
| HMX1 | | NM_018942 | 393 | Homeobox | homeo box (H6 family) 1 |
| HMX2 | | NM_005519.1 | 394 | Homeobox | homeo box (H6 family) 2 |
| HMX3 | | XM_114950 | 395 | Homeobox | homeo box (H6 family) 3 |
| HNF4A | | NM_000457 | 396 | NHR | hepatocyte nuclear factor 4, alpha |
| HNF4G | | NM_004133 | 397 | NHR | hepatocyte nuclear factor 4, gamma |
| HOP | | NM_032495 | 398 | Homeobox | homeodomain-only protein |
| HOXA1 | | NM_005522 | 399 | Homeobox | homeobox A1 |
| HOXA10 | | NM_018951 | 400 | Homeobox | homeobox A10 |
| HOXA11 | | NM_005523 | 401 | Homeobox | homeobox A11 |
| HOXA13 | | NM_000522 | 402 | Homeobox | homeobox A13 |
| HOXA2 | | NM_006735 | 403 | Homeobox | homeobox A2 |
| HOXA3 | | NM_030661 | 404 | Homeobox | homeobox A3 |
| HOXA4 | | NM_002141 | 405 | Homeobox | homeobox A4 |
| HOXA5 | | NM_019102 | 406 | Homeobox | homeobox A5 |
| HOXB9 | | NM_024017 | 407 | Homeobox | homeobox B9 |
| HOXC10 | | NM_017409 | 408 | Homeobox | homeobox C10 |
| HOXC11 | | NM_014212 | 409 | Homeobox | homeobox C11 |
| HOXC12 | | X99631 | 410 | Homeobox | homeoboxC12 |
| HOXC13 | | NM_017410 | 411 | Homeobox | homeoboxC13 |
| HOXC4 | | NM_014620 | 412 | Homeobox | homeoboxC4 |
| HOXC5 | | NM_018953 | 413 | Homeobox | homeobox C5 |
| HOXC6 | | NM_004503 | 414 | Homeobox | homeobox C6 |
| HOXC8 | | NM_022658 | 415 | Homeobox | homeobox C8 |
| HOXC9 | | NM_006897 | 416 | Homeobox | homeobox C9 |
| HOXD1 | | NM_024501 | 417 | Homeobox | homeobox D1 |
| HOXD10 | | NM_002148 | 418 | Homeobox | homeobox D10 |
| HOXD11 | | NM_021192 | 419 | Homeobox | homeobox D11 |
| HOXD12 | | NM_021193 | 420 | Homeobox | homeobox D12 |
| HOXD13 | | NM_000523 | 421 | Homeobox | homeobox D13 |
| HOXD3 | | NM_006898 | 422 | Homeobox | homeobox D3 |
| HOXD4 | | NM_014621 | 423 | Homeobox | homeobox D4 |
| HOXD8 | | NM_019558 | 424 | Homeobox | homeobox D8 |
| HOXD9 | | NM_014213 | 425 | Homeobox | homeobox D9 |
| HPCA | NT_00451193 | NM_002143 | 426 | Other | hippocalcin |
| HPCAL1 | NT_005334:412 | NM_002149 | 427 | Other | hippocalcin-like 1 |
| H-plk | | NM_015852 | 428 | ZnF-C2H2 | Krueppel-related zinc finger protein |
| HR | | AF039196 | 429 | Jumonji | hairless |
| HRIHFB2122 | | NM_007032 | 430 | Other | Tara-like protein (*Drosophila*) |
| HRY | | NM_005524 | 431 | bHLH | hairy (*Drosophila*)-homolog |
| HS747E2A | | NM_015370 | 432 | Other | hypothetical protein (RING domain) |
| HSA275986 | | NM_018403 | 433 | Other | transcription factor SMIF |
| HSAJ2425 | | NM_017532 | 434 | NHR | p65 protein |
| HSF1 | | NM_005526 | 435 | Heat shock | Heat shock transcription factor 1 |
| HSF2 | | NM_004506 | 436 | Heat shock | Heat shock transcription factor 2 |
| HSF2BP | | NM_007031 | 437 | Co-activator | Heat shock transcription factor 2 binding protein |
| HSF4 | | NM_001538 | 438 | Heat shock | Heat shock transcription factor 4 |
| HSFY | | NM_033108 | 439 | Heat shock | Heat shock transcription factor, Y-linked |
| HSGT1 | | NM_007265 | 440 | Other | suppressor of *S. cerevisiae* gcr2 |
| HSHPX5 | | X74862 | 441 | Other | HPX-5 |
| HSPC018 | | NM_014027 | 442 | Other | HSPC018 protein |
| HSPC059 | NT_011233:37 | NM_016536 | 443 | ZnF-C2H2 | HSPC059 protein |
| HSPC063 | NT_033899:972 | NM_014155 | 444 | ZnF-C2H2 | HSPC063 protein |
| HSPC189 | | NM_016535 | 445 | Other | HSPC189 protein |

TABLE 1-continued

Exemplary Human Transcription Factors

| Gene Abbrev | ScriptSureID | mRNA ID | SEQ ID NO: | Class | Description |
|---|---|---|---|---|---|
| HSPX153 | | X76978 | 446 | Homeobox | HPX-153 homeobox |
| HSRNAFEV | NT_005403:123 | NM_017521 | 447 | Trp Cluster-Ets | FEV protein |
| HSU79252 | | NM_013298 | 448 | Other | hypothetical protein |
| ID1 | | NM_002165 | 449 | bHLH | inhibitor of DNA binding 1, negative helix-loop-helix protein |
| ID2 | | NM_002166 | 450 | bHLH | inhibitor of DNA binding 2, dominant negative helix-loop-helix protein |
| ID2B | NT_005999:169 | M96843 | 451 | bHLH | inhibitor of DNA binding 2B, dominant negative helix-loop-helix protein |
| ID3 | | NM_002167 | 452 | bHLH | inhibitor of DNA binding 3, dominant negative helix-loop-helix protein |
| ID4 | | NM_001546 | 453 | bHLH | inhibitor of DNA binding 4, dominant negative helix-loop-helix protein |
| IGHMBP2 | | NM_002180 | 454 | ZnF-AN1 | immunoglobulin mu binding protein 2 |
| ILF1 | | NM_004514 | 455 | Forkhead | interleukin in enhancer binding factor 1 |
| ILF2 | | NM_004515 | 456 | ZnF-C2H2 | interleukin enhancer binding factor 2, 45 kDa |
| ILF3 | | NM_012218 | 457 | ZnF-C2H2 | interleukin enhancer binding factor, 3, 90 kDa |
| INSM1 | | NM_002196 | 458 | ZnF-C2H2 | insulinoma-associated 1 |
| INSM2 | | NM_032594 | 459 | ZnF-C2H2 | insulinoma-associated protein 1A-6 |
| IPF1 | | NM_000209 | 460 | Homeobox | insulin promoter factor 1, homeodomain transcription factor |
| IRF1 | | NM_002198 | 461 | Trp cluster-IRF | interferon regulatory factor 1 |
| IRF2 | | NM_002199 | 462 | Trp cluster-IRF | interferon regulatory factor 2 |
| IRF3 | | NM_001571 | 463 | Trp cluster-IRF | interferon regulatory factor 3 |
| IRF4 | | NM_002460 | 464 | Trp cluster-IRF | interferon regulatory factor 4 |
| IRF5 | | NM_002200 | 465 | Trp cluster-IRF | interferon regulatory factor 5 |
| IRF6 | | NM_006147 | 466 | Trp cluster-IRF | interferon regulatory factor 6 |
| IRF7 | | NM_001572 | 467 | Trp cluster-IRF | interferon regulatory factor 7 |
| IRLB | | X63417 | 468 | Other | c-myc promoter-binding protein |
| IRX1 | | U90307 | 469 | Homeobox | iroquois homeobox protein 1 |
| IRX2 | | AF319967 | 470 | Homeobox | iroquois homeobox protein 2 |
| IRX3 | | U90308 | 471 | Homeobox | iroquois homeobox protein 3 |
| IRX4 | | NM_016358 | 472 | Homeobox | Iroquois homeobox protein 4 |
| IRX5 | | NM_005853 | 473 | Homeobox | Iroquois homeobox protein 5 |
| IRX6 | | U90305 | 474 | Homeobox | Iroquois homeobox protein 6 |
| JARID1A | NT_009759:29 | NM_005056 | 475 | Jumonji | Jumonji, AT rich interactive domain 1A (RBP2-like) |
| JARID1B | NT_034408:191 | NM_006618 | 476 | Jumonji | Jumonji, AT rich interactive domain 1B (RBP2-like) |
| JARID1D | NT_011875:152 | NM_004653 | 477 | Jumonji | Jumonji, AT rich interactive domain 1D (RBP2-like) |
| JDP2 | NT_026437:1173 | NM_130469 | 478 | bZIP | jun dimerization protein 2 |
| JMJ | | NM_004973 | 479 | Jumonji | jumonji homolog (mouse) |
| JMJD1 | NT_015805:184 | NM_018433 | 480 | Jumonji | jumonji domain containing 1 |
| JMJD2 | NT_032971:21 | BC002558 | 481 | Jumonji | jumonji domain containing 2 |
| JMJD2B | NT_011255:298 | AK026040 | 482 | Jumonji | jumonji domain-containing 2B |

TABLE 1-continued

Exemplary Human Transcription Factors

| Gene Abbrev | ScriptSureID | mRNA ID | SEQ ID NO: | Class | Description |
|---|---|---|---|---|---|
| JUN | | NM_002228 | 483 | bZIP | v-jun avan sarcoma virus 17 oncogene homolog |
| JUNB | | NM_002229 | 484 | bZIP | Jun B proto-oncogene |
| JUND | | NM_005354 | 485 | bZIP | Jun D proto-oncogene |
| KBTBD10 | NT_005332:189 | NM_006063 | 486 | ZnF-BTB/POZ | kelch repeat and BTB (POZ) domain containing 10 |
| KBTBD5 | NT_005825:210 | NM_152393 | 487 | ZnF-BTB/POZ | kelch repeat and BTB (POZ) domain containing 5 |
| KBTBD7 | NT_009984:758 | NM_032138 | 488 | ZnF-BTB/POZ | kelch repeat and BTB (POZ) domain containing 7 |
| KCNIP1 | NT_023132:191 | NM_014592 | 489 | Other | Kv channel interacting protein 1 |
| KCNIP2 | NT_030059:932 | NM_014591 | 490 | Other | Kv channel interacting protein 2 |
| KCNIP4 | NT_006344:469 | NM_025221 | 491 | Other | Kv channel interacting protein 4 |
| KEAP1 | | NM_012289 | 492 | Other | Kelch-like ECH-associated protein 1 |
| KLF1 | | NM_006563 | 493 | ZnF-C2H2 | Kruppel-like factor 1 (erythroid) |
| KLF12 | | NM_007249 | 494 | ZnF-C2H2 | Kruppel-like factor 12 |
| KLF13 | | NM_015995 | 495 | ZnF-C2H2 | Kruppel-like factor 13 |
| KLF14 | | NM_138693 | 496 | ZnF-C2H2 | Kruppel-like factor 14 |
| KLF15 | | NM_014079 | 497 | ZnF-C2H2 | Kruppel-like factor 15 |
| KLF16 | | NM_031918 | 498 | ZnF-C2H2 | Kruppel-like factor 16 |
| KLF2 | | NM_016270 | 499 | ZnF-C2H2 | Kruppel-like factor 2 (lung) |
| KLF3 | | NM_016531 | 500 | ZnF-C2H2 | Kruppel-like factor 3 (basic) |
| KLF4 | | NM_004235 | 501 | ZnF-C2H2 | Kruppel-like factor 4 (gut) |
| KLF5 | | NM_001730 | 502 | ZnF-C2H2 | Kruppel-like factor 5 (intestinal) |
| KLF7 | | NM_003709 | 503 | ZnF-C2H2 | Kruppel-like factor 7 (ubiquitous) |
| KLF8 | | NM_007250 | 504 | ZnF-C2H2 | Kruppel-like factor 8 |
| KLHL1 | NT_024524:413 | NM_020866 | 505 | ZnF-BTB/POZ | kelch-like 1 (Drosophila) |
| KLHL3 | NT_016714:116 | NM_017415 | 506 | ZnF-BTB/POZ | kelch-like 3 (Drosophila) |
| KLHL4 | NT_011689:82 | NM_019117 | 507 | ZnF-BTB/POZ | kelch-like 4 (Drosophila) |
| KLHL5 | | NM_015990 | 508 | ZnF-BTB/POZ | kelch-like 5 (Drosophila) |
| KLHL6 | NT_022676:150 | NM_130446 | 509 | ZnF-BTB/POZ | kelch-like 6 (Drosophila) |
| KLHL8 | NT_006204:183 | NM_020803 | 510 | ZnF-BTB/POZ | kelch-like 8 |
| LDB1 | | NM_003893 | 511 | Co-activator | LIM domain binding 1 |
| LDB2 | | NM_001290 | 512 | Co-activator | LIM domain binding 2 |
| LDOC1 | | NM_012317 | 513 | bZIP | leucine zipper, down-regulated in cancer 1 |
| LEF1 | | NM_016269 | 514 | Beta-scaffold-HMG | lymphoid enhancer factor 1 |
| LHX1 | | NM_005568 | 515 | Homeobox | LIM homeobox protein 1 |
| LHX2 | | NM_004789 | 516 | Homeobox | LIM homeobox protein 2 |
| LHX3 | | NM_014564 | 517 | Homeobox | LIM homeobox protein 3 |
| LHX4 | | NM_033343 | 518 | Homeobox | LIM homeobox protein 4 |
| LHX5 | | NM_022363 | 519 | Homeobox | LIM homeobox protein 5 |
| LHX6 | | NM_014368 | 520 | Homeobox | LIM homeobox protein 6 |
| LHX8 | | AB050476 | 521 | Homeobox | LIM homeobox protein 8 |
| LHX9 | | AJ277915 | 522 | Homeobox | LIM homeobox protein 9 |
| LIM | | NM_006457 | 523 | Co-activator | LIM protein (similar to rat protein kinase C-binding enigma) |
| LIN28 | | NM_024674 | 524 | Beta-scaffold-cold-shock | RNA-binding protein LIN-28 |
| LISCH7 | | NM_015925 | 525 | bHLH | liver-specific bHLH-Zip transcription factor |
| LMO1 | | NM_002315 | 526 | ZnF-Other | LIM domain only 1 (rhombotin 1) |
| LMO2 | | NM_005574 | 527 | ZnF-Other | LIM domain only 2 (rhombotin-like 1) |
| LMO4 | | NM_006769 | 528 | ZnF-Other | LIM domain only 4 |

TABLE 1-continued

Exemplary Human Transcription Factors

| Gene Abbrev | ScriptSureID | mRNA ID | SEQ ID NO: | Class | Description |
|---|---|---|---|---|---|
| LMO6 | | NM_006150 | 529 | ZnF-Other | LIM domain only 6 |
| LMO7 | | NM_005358 | 530 | ZnF-Other | LIM domain only 7 |
| LMX1A | | AY078398 | 531 | Homeobox | LIM homeobox transcription factor 1, alpha |
| LMX1B | | NM_002316 | 532 | Homeobox | LIM homeobox transcription factor 1, beta |
| LOC113655 | | BC011982 | 533 | Other | hypothetical protein BC011982 |
| LOC115468 | NT_035560:126a | NM_145326 | 534 | ZnF-C2H2 | similar to hypothetical protein FLJ13659 |
| LOC115509 | NT_024802:36 | NM_138447 | 535 | ZnF-C2H2 | hypothetical protein BC014000 |
| LOC115950 | NT_011176:403 | NM_138783 | 536 | ZnF-C2H2 | hypothetical protein BC016816 |
| LOC126295 | NT_011255:1 | NM_173480 | 537 | ZnF-C2H2 | hypothetical protein LOC126295 |
| LOC146542 | NT_024802:32a | NM_145271 | 538 | ZnF-C2H2 | similar to hypothetical protein MGC13138 |
| LOC148213 | NT_033317:111 | NM_138286 | 539 | ZnF-C2H2 | hypothetical protein FLJ31526 |
| LOC151162 | | AF055029 | 540 | Other | hypothetical protein LOC151162 |
| LOC283248 | NT_033241:294 | NM_173587 | 541 | Trp Cluster-Myb | hypothetical protein LOC283248 |
| LOC284346 | NT_011109:18 | NM_174945 | 542 | ZnF-C2H2 | hypothetical protein LOC284346 |
| LOC285346 | NT_034534:55 | BC014381 | 543 | Methyl-CpG-binding | hypothetical protein LOC285346 |
| LOC286103 | NT_031818:174 | NM_178535 | 544 | ZnF-C2H2 | hypothetical protein LOC286103 |
| LOC51036 | | NM_015854 | 545 | Other | retinoic acid receptor-beta associated open reading frame |
| LOC51042 | | NM_015871 | 546 | ZnF-C2H2 | zinc finger protein |
| LOC51045 | | NM_015877 | 547 | ZnF-C2H2 | Kruppel-associated box protein |
| LOC51058 | | NM_015911 | 548 | ZnF-C2H2 | hypothetical protein |
| LOC51123 | | NM_016096 | 549 | ZnF-C2H2 | HSPC038 protein |
| LOC51186 | | NM_016303 | 550 | Other | pp21 homolog |
| LOC51193 | | NM_016331 | 551 | ZnF-C2H2 | zinc finger protein ANC_2H01 |
| LOC51270 | | NM_016521 | 552 | E2F | E2F-like protein |
| LOC51290 | | NM_016570 | 553 | Other | CDA14 |
| LOC51333 | NT_024802:6 | NM_016643 | 554 | ZnF-C2H2 | mesenchymal stem cell protein DSC43 |
| LOC55893 | | NM_018660 | 555 | ZnF-C2H2 | papillomavirus regulatory factor PRF-1 |
| LOC56270 | | NM_019613 | 556 | Other | hypothetical protein 628 |
| LOC56930 | | AL365410 | 557 | Other | hypothetical protein from EUROIMAGE 1669387 |
| LOC57209 | | AJ245587 | 558 | ZnF-C2H2 | Kruppel-type zinc finger protein |
| LOC57801 | | NM_021170 | 559 | bHLH | hairy and enhancer of split 4 (Drosophila) |
| LOC58500 | | X16282 | 560 | ZnF-C2H2 | zinc finger protein (clone 647) |
| LOC65243 | | NM_023070 | 561 | ZnF-C2H2 | hypothetical protein |
| LOC86614 | | NM_033108 | 562 | Heat shock | Heat shock transcription factor 2-like |
| LOC90322 | | AK001357 | 563 | ZnF-C2H2 | similar to KRAB zinc finger protein KR18 |
| LOC90462 | | AK027873 | 564 | ZnF-C2H2 | similar to Zinc finger protein 84 (Zinc finger protein HPF2) |
| LOC90589 | NT_011176:506 | NM_145233 | 565 | bZIP | similar to Zinc finger protein 20 (Zinc finger protein KOX13) |
| LOC90987 | | AK000435 | 566 | ZnF-C2H2 | similar to ZINC FINGER PROTEIN 184 |
| LOC91120 | | NM_033196 | 567 | ZnF-C2H2 | similar to ZINC FINGER PROTEIN 85 (ZINC FINGER PROTEIN HPF4) (HTF1) (H. sapiens) |

TABLE 1-continued

Exemplary Human Transcription Factors

| Gene Abbrev | ScriptSureID | mRNA ID | SEQ ID NO: | Class | Description |
|---|---|---|---|---|---|
| LOC91464 | NT_011520:1976 | AK025181 | 568 | Homeobox | hypothetical protein LOC91464 |
| LOC91614 | | AJ245600 | 569 | Other | novel 58.3 KDA protein |
| M96 | | NM_007358 | 570 | ZnF-PHD | likely ortholog of mouse metal response element binding transcription factor 2 |
| MAD | | NM_002357 | 571 | bHLH | MAX dimerization protein 1 |
| MADH1 | | NM_005900 | 572 | Dwarfin | MAD, mothers against decapentaplegic homolog 1 (Drosophila) |
| MADH2 | | NM_005901 | 573 | Dwarfin | MAD, mothers against decapentaplegic homolog 2 (Drosophila) |
| MADH3 | | NM_005902 | 574 | Dwarfin | MAD, mothers against decapentaplegic homolog 3 (Drosophila) |
| MADH4 | | NM_005359 | 575 | Dwarfin | MAD, mothers against decapentaplegic homolog 4 (Drosophila) |
| MADH5 | | NM_005903 | 576 | Dwarfin | MAD, mothers against decapentaplegic homolog 5 (Drosophila) |
| MADH6 | | NM_005585 | 577 | Dwarfin | MAD, mothers against decapentaplegic homolog 6 (Drosophila) |
| MADH7 | | NM_005904 | 578 | Dwarfin | Mad, mothers against decapentaplegic homolog 7 (Drosophila) |
| MADH9 | | NM-005905 | 579 | Dwarfin | MAD, mothers against decapentaplegic homolog 9 (Drosophila) |
| MAF | | NM_005360 | 580 | bZIP | v-maf musculoaponeurotic fibrosarcoma oncogene homolog (avian) |
| MAFB | | NM_005461 | 581 | bZIP | v-maf musculoaponeurotic fibrosarcoma oncogene homolog B (avian) |
| MAFF | | NM_012323 | 582 | bZIP | v-maf musculoaponeurotic fibrosarcoma oncogene family, protein F (avian) |
| MAFG | | NM_002359 | 583 | bZIP | v-maf musculoaponeurotic fibrosarcoma oncogene family, protein G (avian) v-maf musculoaponeurotic |
| MBD4 | | NM_003925 | 584 | Methyl-CpG-binding | methyl-CpG binding domain protein 4 |
| MBNL2 | | NM_005757 | 585 | ZnF-C3H | muscleblind-like 2 (Drosophila) |
| MDS032 | | NM_018467 | 586 | Other | uncharacterized hematopoietic stem/progenitor cells protein MDS032 |
| MDS1 | | NM_004991 | 587 | Other | myelodysplasia syndrome 1 |
| MECP2 | | NM_004992 | 588 | Methyl-CpG-binding | methyl CpG binding protein 2 (Rett syndrome) |
| MED6 | | NM_005466 | 589 | Co-activator | mediator of RNA polymerase II transcription, subunit 6 homolog (yeast) |
| MEF2A | | NM_005587 | 590 | Beta-scaffold-MADS | MADS box transcription enhancer factor 2, polypeptide A (myocyte enhancer factor 2A) |
| MEF2B | | NM_005919 | 591 | Beta-scaffold-MADS | MADS box transcription enhancer factor 2, polypeptide B (myocyte enhancer factor 2B) |
| MEF2C | | NM_002397 | 592 | Beta-scaffold-MADS | MADS box transcription enhancer factor 2, polypeptide C (myocyte enhancer factor 2C) |

TABLE 1-continued

Exemplary Human Transcription Factors

| Gene Abbrev | ScriptSureID | mRNA ID | SEQ ID NO: | Class | Description |
|---|---|---|---|---|---|
| MEF2D | | NM_005920 | 593 | Beta-scaffold-MADS | MADS box transcription enhancer factor 2, polypeptide D (myocyte enhancer factor 2D) |
| MEFV | | NM_000243 | 594 | Co-activator | Mediterranean fever (pyrin) |
| MEIS1 | | NM_002398 | 595 | Homeobox | Meis1, myeloid ecotropic viral integration site 1 homolog (mouse) |
| MEIS2 | | NM_020149 | 596 | Homeobox | Meis1, myeloid ecotropic viral integration site 1 homolog 2 (mouse) |
| MEIS3 | | U68385 | 597 | Homeobox | Meis1, myeloid ecotropic viral integration site 1 homolog 3 (mouse) |
| MEOX1 | | NM_004527 | 598 | Homeobox | mesenchyme homeobox 1 |
| MEOX2 | | NM_005924 | 599 | Homeobox | mesenchyme homeobox 2 (growth arrest-specific homeo box) |
| MESP1 | NT_033276:146 | NM_018670 | 600 | bHLH | mesoderm posterior 1 |
| MESP2 | | AL360139 | 601 | bHLH | mesoderm posterior 2 |
| METTL3 | | NM_019852 | 602 | Other | methyltransferase like 3 |
| MGA | | AB011090 | 603 | bHLH | MAX gene associated |
| MHC2TA | | NM_000246 | 604 | Other | MHC class II transactivator |
| MID1 | | NM_000381 | 605 | Structural | midline 1 (Opitz/BBB syndrome) |
| MID2 | NT_011651:146 | NM_012216 | 606 | Structural | midline 2 |
| MI-ER1 | | NM_020948 | 607 | Other | mesoderm induction early response 1 |
| MILD1 | | NM_031944 | 608 | Homeobox | Mix1 homeobox-like 1 (*Xenopus laevis*) |
| MITF | | NM_000248 | 609 | bHLH | microphthalmia-associated transcription factor |
| MLLT1 | | NM_005934 | 610 | AF-4 | myeloid/lymphoid or mixed-lineage leukemia (thrithorax (*Drosophila*) homolog); translocated to, 1 |
| MLLT10 | | NM_004641 | 611 | ZnF-PHD | myeloid/lymphoid or mixed-lineage keukemia (trithorax (*Drosophila*) homolog); translocated to 10 |
| MLLT2 | | NM_005935 | 612 | AF-4 | myeloid/lymphoid or mixed-lineage leukemia (trithorax (*Drosophila*) homolog); translocated to 2 |
| MLLT3 | | NM_004529 | 613 | AF-4 | myleoid/lymphoid or mixed-lineage leukemia (trithorax (*Drosophila*) homolog); translocated to 3 |
| MLLT4 | | NM_005936 | 614 | Structural | myeloid/lymphoid or mixed-lineage leukemia (trithorax (*Drosophila*) homolog); translocated to 4 |
| MLLT6 | | NM_005937 | 615 | ZnF-PHD | myeloid/lymphoid or mixed-lineage leukemia (trithorax (*Drosophila*) homolog); translocated to 6 |
| MLLT7 | | NM_005938 | 616 | Forkhead | myeloid/lymphoid or mixed-lineage leukemia (trithorax (*Drosophila*) homolog); translocated to, 7 |
| MNAT1 | | NM_002431 | 617 | ZnF-Other | menage a trois 1 (CAK assembly factor) |
| MNDA | | NM_002432 | 618 | Other | myeloid cell nuclear differentiation antigen |
| MNT | | NM_020310 | 619 | bHLH | MAX binding protein |
| MONDOA | | NM_014938 | 620 | bHLH | Mix interactor |
| MORF | | NM_012330 | 621 | ZnF-PHD | monocytic leukemia zinc finger protein-related facto |
| MORF4 | | NM_006792 | 622 | Structural | mortality factor 4 |
| MORF4L1 | | NM_006791 | 623 | Structural | mortality factor 4 like 1 |
| MORF4L2 | | NM_012286 | 624 | Structural | mortality factor 4 like 2 |

TABLE 1-continued

Exemplary Human Transcription Factors

| Gene Abbrev | ScriptSureID | mRNA ID | SEQ ID NO: | Class | Description |
|---|---|---|---|---|---|
| MRF-1 | | BC032488 | 625 | Structural | modulator recognition factor 1 |
| MRF2 | | BC015120 | 626 | Structural | modulator recognition factor 2 |
| MRG2 | | AL359938 | 627 | Homeobox | likely ortholog of mouse myeloid ecotropic viral integration site-related gene 2 |
| MTF1 | | NM_005955 | 628 | ZnF-C2H2 | [cut off] transcription factor 1 |
| MXD3 | | NM_031300 | 629 | bHLH | MAX dimerization protein 3 |
| MXD4 | | NM_006454 | 630 | bHLH | MAX dimerization protein 4 |
| MXI1 | | NM_005962 | 631 | bHLH | MAX interacting protein 1 |
| MYB | | NM_005375 | 632 | Trp cluster-Myb. | v-myb myeloblastosis viral oncogene homolog (avian) |
| MYBBP1A | | NM_014520 | 633 | Co-repressor | MYB binding protein (P160) 1a |
| MYBL1 | | X66087 | 634 | Trp cluster-Myb | v-myb myeloblastosis viral oncogene homolog (avian)-like 1 |
| MYBL2 | | NM_002466 | 635 | Trp cluster-Myb | v-myb myeloblastosis viral oncogene homolog (avian)-like 2 |
| MYC (c-MYC) | | NM_002467 | 636 | bHLH | v-myc myelocytomatosis viral oncogene homolog (avian) |
| MYCBP | | NM_012333 | 637 | Co-activator | c-myc binding protein |
| MYCL1 | | M19720 | 638 | bHLH | v-myc myelocytomatosis viral oncogene homolog, lung carcinoma derived (arivan) |
| MYCL2 | | NM_005377 | 639 | bHLH | v-myc myelocytomatosis viral oncogene homolog 2 (avian) |
| MYCLK1 | | M64786 | 640 | bHLH | v-myc myelocytomatosis viral oncogene homolog (avian)-like 1 |
| MYCN | | NM_005378 | 641 | bHLH | v-myc myelocytomatosis viral related oncogene, neuroblastoma derived (avian) |
| MYF5 | | NM_005593 | 642 | bHLH | myogenic factor 5 |
| MYF6 | | NM_002469 | 643 | bHLH | myogenic factor 6 (herculin) |
| MYNN | NT_010840:25 | NM_018657 | 644 | ZnF-BTB/POZ | myoneurin |
| MYOD1 | | NM_002478 | 645 | bHLH | myogenic factor 3 |
| MYOG | | NM_002479 | 646 | bHLH | myogenin (myogenic factor 4) |
| MYT1 | | NM_004535 | 647 | ZnF-Other | myelin transcription factor 1 |
| MYT1L | | AF036943 | 648 | ZnF-Other | myelin transcription factor 1-like |
| MYT2 | | NM_003871 | 649 | Other | myelin transcription factor 2 |
| NAB1 | | NM_005966 | 650 | Co-repressor | NGFI-A binding protein 1 (EGR1 binding protein 1) |
| NAB2 | | NM_005967 | 651 | Co-repressor | NGFI-A binding protein 2 (EGR1 binding protein 2) |
| NCALD | | NM_032041 | 652 | Other | neurocalcin delta |
| NCOA1 | | NM_003743 | 653 | Co-activator | nuclear receptor |
| NCYM | | NM_006316 | 654 | Other | transcriptional activator |
| NEUD4 | | NM_004647 | 655 | ZnF-PHD | Neuro-d4 (rat) homolog |
| NEUROD1 | | NM_002500 | 656 | bHLH | neurogenic differentiation 1 |
| NEUROD2 | | NM_006160 | 657 | bHLH | neurogenic differentiation 2 |
| NEUROD4 | | NM_021191 | 658 | bHLH | neurogenic differentiation 4 |
| NEUROD6 | | NM_022728 | 659 | bHLH | neurogenic differentiation 6 |
| NEUROG1 | | NM_006161 | 660 | bHLH | neurogenin 1 |
| NEUROG2 | | AF303002 | 661 | bHLH | neurogenin 2 |
| NEUROG3 | | NM_020999 | 662 | bHLH | neurogenin 3 |
| NFAT5 | | NM_006599 | 663 | Beta-scaffold-RHD | nuclear factor of activated T-cells 5, tonicity-responsive |

TABLE 1-continued

Exemplary Human Transcription Factors

| Gene Abbrev | ScriptSureID | mRNA ID | SEQ ID NO: | Class | Description |
|---|---|---|---|---|---|
| NFATC1 | | NM_006162 | 664 | Beta-scaffold-RHD | nuclear factor of activated T-cells, cytoplasmic, calcineurin-dependent 1 |
| NFATC2 | | NM_012340 | 665 | Beta-scaffold-RHD | nuclear factor of activated T-cells, cytoplasmic, calcineurin-dependent 2 |
| NFATC3 | | NM_004555 | 666 | Beta-scaffold-RHD | nuclear factor of activated T-cells, cytoplasmic, calcineurin-dependent 3 |
| NFATC4 | | NM_004554 | 667 | Beta-scaffold-RHD | nuclear factor of activated T-cells, cytoplasmic, calcineurin-dependent 4 |
| NFE2 | | NM_006163 | 668 | bZIP | nuclear factor (erythroid-derived 2), 45 kD |
| NFE2L1 | | NM_003204 | 669 | bZIP | nuclear factor (erythroid-derived 2)-like 1 |
| NFE2L2 | | NM_006164 | 670 | bZIP | nuclear factor (erythroid-derived 2)-like 2 |
| NFE2L3 | | NM_004289 | 671 | bZIP | nuclear factor (erythroid-derived 2)-like 3 |
| NFIA | | AB037860 | 672 | Beta-scaffold-CCAAT | nuclear factor I/A |
| NFIB | | NM_005596 | 673 | Beta-scaffold-CCAAT | nuclear factor I/B |
| NFIC | | NM_005597 | 674 | Beta-scaffold-CCAAT | nuclear factor I/C (CCAAT-binding transcription factor) |
| NFIL3 | | NM_005384 | 675 | bZIP | nuclear factor, interleukin 3 regulated |
| NFIX | | NM_002501 | 676 | Beta-scaffold-CCAAT | nuclear factor I/X (CCAAT-binding transcription factor) |
| NFKBIB | | NM_002503 | 677 | Co-activator | kappa light polypeptide gene enhancer in B-cells inhibitor, beta |
| NFKBIE | | NM_004556 | 678 | Co-repressor | nuclear factor of kappa light polypeptide gene enhancer in B-cells inhibitor, epsilon |
| NFKBIL1 | | NM_005007 | 679 | Co-repressor | nuclear factor of kappa light polypeptide gene enhancer in B-cells inhibitor-like 1 |
| NFKBIL2 | | NM_013432 | 680 | Co-repressor | nuclear factor of kappa light polypeptide gene enhancer in B-cells inhibitor-like 2 |
| NFRKB | | NM_006165 | 681 | Beta-scaffold-RHD | nuclear factor related to kappa B binding protein |
| NFX1 | | NM_002504 | 682 | RFX | nuclear transcription factor, X-box binding 1 |
| NFYA | | NM_002505 | 683 | Beta-scaffold-CCAAT | nuclear transcription factor Y, alpha |
| NFYB | | NM_006166 | 684 | Beta-scaffold-CCAAT | nuclear transcription factor Y, beta |
| NFYC | | NM_014223 | 685 | Beta-scaffold-CCAAT | nuclear transcription factor Y, gamma |
| NHLH1 | NT_004982:183 | NM_005598 | 686 | bHLH | nescient helix loop helix 1 |
| NHLH2 | | NM_005599 | 687 | bHLH | nescient helix loop helix 2 |
| NKX2-2 | | NM_002509 | 688 | Homeobox | NK2 transcription factor related, locus 2 (*Drosophila*) |
| NKX2-3 | | NM_145285 | 689 | Homeobox | NK2 transcription factor related, locus 3 (*Drosophila*) |
| NKX2-4 | | AF202037 | 690 | Homeobox | NK2 transcription factor related, locus 4 (*Drosophila*) |
| NKX2-5 | | NM_004387 | 691 | Homeobox | NK2 transcription factor related, locus 5 (*Drosophila*) |
| NKX2-8 | | NM_014360 | 692 | Homeobox | NK2 transcription factor related, locus 8 (*Drosophila*) |

TABLE 1-continued

Exemplary Human Transcription Factors

| Gene Abbrev | ScriptSureID | mRNA ID | SEQ ID NO: | Class | Description |
|---|---|---|---|---|---|
| NKX3-1 | | NM_006167 | 693 | Homeobox | NK3 transcription factor related, locus 1 (*Drosophila*) |
| NKX6-1 | | NM_006168 | 694 | Homeobox | NK6 transcription factor related, locus 1 (*Drosophila*) |
| NKX6-2 | | NM_177400 | 695 | Homeobox | NK6 transcription factor related, locus 2 (*Drosophila*) |
| NM1 | | NM_004688 | 696 | Co-activator | N-myc (and STAT) interactor |
| NPAS1 | | NM_002517 | 697 | bHLH | neuronal PAS domain protein 1 |
| NR1D2 | | NM_005126 | 698 | NHR | subfamily 1, group D, member 2 |
| NR1H2 | | NM_007121 | 699 | NHR | nuclear receptor subfamily 1, group H, member 2 |
| NR1H3 | | NM_005693 | 700 | NHR | nuclear receptor subfamily 1, group H, member 3 |
| NR1H4 | | NM_005123 | 701 | NHR | nuclear receptor subfamily 1, group H, member 4 |
| NR1I2 | | NM_003889.3 | 702 | NHR | nuclear receptor subfamily 1, group I, member 2 (isoforms 1-3) |
| | | NM_022002.2 | 1485 | | |
| | | NM_033013.2 | 1486 | | |
| NRI13 | | NM_005122 | 703 | NHR | nuclear receptor subfamily 1, group I, member 3 |
| NR2C1 | | NM_003297 | 704 | NHR | nuclear receptor subfamily 2, group C, member 1 |
| NR2C2 | | NM_003298 | 705 | NHR | nuclear receptor subfamily 2, group C, member 2 |
| NR2E1 | | NM_003269 | 706 | NHR | nuclear receptor subfamily 2, group E, member 1 |
| NR2E3 | | NM_016346 | 707 | NHR | nuclear receptor subfamily 2, group E, member 3 |
| NR2F1 | | NM_005654 | 708 | NHR | nuclear receptor subfamily 2, group F, member 1 |
| NR2F2 | | NM_021005 | 709 | NHR | nuclear receptor subfamily 2, group F, member 2 |
| NR2F6 | | NM_005234 | 710 | NHR | nuclear receptor subfamily 2, group F, member 6 |
| NR3C1 | | NM_000176 | 711 | NHR | nuclear receptor subfamily 3, group C, member 1 (glucocorticoid receptor) |
| NR3C2 | | NM_000901 | 712 | NHR | nuclear receptor subfamily 3, group C, member 2 |
| NR4A1 | | NM_002135 | 713 | NHR | nuclear receptor subfamily 4, group A, member 1 |
| NR4A2 | | NM_006186 | 714 | NHR | nuclear receptor subfamily 4, group A, member 2 |
| NR4A3 | | NM_006981 | 715 | NHR | nuclear receptor subfamily 4, group A, member 3 |
| NR5A1 | | NM_004959 | 716 | NHR | nuclear receptor subfamily 5, group A, member 1 |
| NR5A2 | | NM_003822 | 717 | NHR | nuclear receptor subfamily 5, group A, member 2 |
| NR6A1 | | NM_001489 | 718 | NHR | nuclear receptor subfamily 6, group A, member 1 |
| NRF | | NM_017544 | 719 | Other | transcription factor |
| OG2x | | AC004534 | 720 | Homeobox | homeobox (mouse) homolog |
| OLIG1 | | BC026989 | 721 | bHLH | oligodendrocyte transcription factor 1 |
| OLIG2 | | NM_005806 | 722 | bHLH | oligodendrocyte transcription factor 2 |
| OLIG3 | | NM_175747 | 723 | bHLH | oligodendrocyte transcription factor 3 |
| ONECUT1 | | U96173 | 724 | Homeobox | one cut domain, family member 1 |
| ONECUT2 | | NM-004852 | 725 | Homeobox | one cut domain, family member 2 |
| OPTN | | NM_021980 | 726 | Co-activator | optineurin |
| OSR1 | | NM_145260 | 727 | ZnF-C2H2 | odd-skipped related 1 |
| OSR2 | NT_008046:515 | NM_053001 | 728 | ZnF-C2H2 | odd-skipped-related 2A protein |

TABLE 1-continued

Exemplary Human Transcription Factors

| Gene Abbrev | ScriptSureID | mRNA ID | SEQ ID NO: | Class | Description |
|---|---|---|---|---|---|
| OTEX | NT_011588:87 | NM_139282 | 729 | Homeobox | paired-like homeobox protein OTEX |
| OTP | NT_006713:546 | NM_032109 | 730 | Homeobox | orthopedia homolog (Drosophila) |
| OTX1 | | NM_014562 | 731 | Homeobox | orthodenticle homolog 1 (Drosophila) |
| OTX2 | | NM_021728 | 732 | Homeobox | orthodenticle homolog 2 (Drosophila) |
| OTX3 | | NM_147192 | 733 | Homeobox | orthodenticle homolog 3 (Drosophila) |
| OVOL1 | | NM_004561 | 734 | ZnF-C2H2 | ovo-like 1(Drosophila) |
| OVOL3 | | AD001527 | 735 | ZnF-C2H2 | ovo-like 3 (Drosophila) |
| p100 | | NM_014390 | 736 | Co-activator | EBNA-2 Co-activator (100 kD) |
| P1P373C6 | | NM_019110 | 737 | ZnF-C2H2 | hypothetical protein P1 p373c6 |
| P381IP | | NM_017569 | 738 | Other | transcription factor (p38 interacting protein) |
| PAWR | NT_019546:106 | NM_002583 | 739 | bZIP | PRKC, apoptosis, WT1, regulator |
| PAX1 | | NM_006192 | 740 | Paired Box | paired box gene 1 |
| PAX2 | | NM_000278 | 741 | Paired Box | paired box gene 2 |
| PAX3 | | NM_000438 | 742 | Paired Box | paired box gene 3 (Waardenburg syndrome 1) |
| PAX4 | | NM_006193 | 743 | Paired Box | paired box gene 4 |
| PAX5 | | NM_016734 | 744 | Paired Box | paired box gene 6 (B-cell lineage specific activator protein) |
| PAX6 | | NM_000280 | 745 | Paired Box | paired box gene 6 (aniridia, keratitis) |
| PAX7 | | NM_002584 | 746 | Paired box | paired box gene 7 |
| PAX8 | | NM_003466 | 747 | Paired Box | paired box gene 8 |
| PAX9 | | NM_006194 | 748 | Paired Box | paired box gene 9 |
| PAXIP1L | | U80735 | 749 | Co-activator | PAX transcription activation domain interacting protein 1 like |
| PBX1 | | NM_002585 | 750 | Homeobox | pre-B-cell leukemia transcription factor 1 |
| PBX2 | | NM_002586 | 751 | Homeobox | pre-B-cell leukemia transcription factor 2 glutamine/Q-rich-associated protein |
| PDEF | | NM_012391 | 752 | Trp cluster-Ets | prostate epithelium-specific Ets transcription factor |
| PEGASUS | | NM_022466 | 753 | ZnF-C2H2 | zinc finger protein, subfamily 1A, 5 (Pegasus) |
| PER1 | | NM_002616 | 754 | bHLH | period homolog 1 (Drosophila) |
| PER2 | | NM_003894 | 755 | bHLH | period homolog 2 (Drosophila) |
| PER3 | | NM_016831 | 756 | bHLH | period homolog 3 (Drosophila) |
| PFDN5 | | NM_002624 | 757 | Co-repressor | prefoldin 5 |
| PGR | | NM_000926 | 758 | NHR | progesterone receptor |
| PHC1 | | NM_004426 | 759 | Structural | polyhomeotic-like 1 (Drosophila) |
| PHD3 | | NM_015153 | 760 | ZnF-PHD | PHD finger protein 3 |
| PHF15 | NT_034776:94 | NM_015288 | 761 | ZnF-PHD | PHD finger protein 15 |
| PHF16 | NT_011568:120 | NM_014735 | 762 | ZnF-PHD | PHD finger protein 6 |
| PHTF1 | | NM_006608 | 763 | Homeobox | putative homeodomain transcription factor |
| PIAS1 | NT_010222:2 | NM_016166 | 764 | ZnF-MIZ | protein inhibitor of activated STAT, 1 |
| PIAS3 | | NM_006099 | 765 | ZnF-MIZ | protein inhibitor of activated STAT3 |
| PIASY | NT_011255:153 | NM_015897 | 766 | ZnF-MIZ | protein inhibitor of activated STAT protein PIASy |
| PIG7 | | NM_004862 | 767 | Other | LPS-induced TNF-alpha factor |
| PILB | | NM_012228 | 768 | Other | pilin-like transcription factor |

TABLE 1-continued

Exemplary Human Transcription Factors

| Gene Abbrev | ScriptSureID | mRNA ID | SEQ ID NO: | Class | Description |
|---|---|---|---|---|---|
| PITX1 | | NM_002653 | 769 | Homeobox | paired-like homeodomain transcription factor 1 |
| PITX2 | | NM_000325 | 770 | Homeobox | paired-like homeodomain transcription factor 2 |
| PITX3 | | NM_005029 | 771 | Homeobox | paired-like homeodomain transcription factor 3 |
| PKNOX1 | | NM_004571 | 772 | Homeobox | PBX/knotted 1 homeobox 1 |
| PKNOX2 | | NM_022062 | 773 | Homeobox | PBX/knotted 1 homeobox 2 |
| PLAG1 | | NM_002655 | 774 | ZnF-C2H2 | pleiomorphic adenoma gene 1 |
| PLGAL1 | | NM_002656 | 775 | ZnF-C2H2 | pleiomorphic adenoma gene-like 1 |
| PLAGL2 | | NM_002657 | 776 | ZnF-C2H2 | pleiomorphic adenoma gene-like 2 |
| PLRG1 | | NM_002669 | 777 | Co-repressor | pleiotropic regulator 1 (PRL1 homolog, *Arabidopsis*) |
| PMF1 | | NM_007221 | 778 | Co-activator | polyamine-modulated factor 1 |
| PML | | NM_002675 | 779 | Structural | promyelocytic leukemia |
| PMX1 | | NM_006902 | 780 | Homeobox | paired mesoderm homeo box 1 |
| POU3F1 | | NM_002699 | 781 | Homeobox | POU domain, class 3, transcription factor 1 |
| POU3F2 | | NM_005604 | 782 | Homeobox | POU domain, class 3, transcription factor 2 |
| POU3F3 | | NM_006236 | 783 | Homeobox | POU domain, class 3, transcription factor 3 |
| POU3F4 | | NM_000307 | 784 | Homeobox | POU domain, class 3, transcription factor 4 |
| POU4F1 | | NM_006237 | 785 | Homeobox | POU domain, class 4, transcription factor 1 |
| POU4F2 | | NM_004575 | 786 | Homeobox | POU domain, class 4, transcription factor 2 |
| POU4F3 | | NM_002700 | 787 | Homeobox | POU domain, class 4, transcription factor 3 |
| POU5F1 (OCT4) | | NM_002701 | 788 | Homeobox | POU domain, class 5, transcription factor 1 |
| POU6F1 | | NM_002702 | 789 | Homeobox | POU domain, class 6, transcription factor 1 |
| PPARA | | NM_005036 | 790 | NHR | peroxisome proliferative activated receptor, alpha |
| PPARBP | | NM_004774 | 791 | Co-activator | peroxisome proliferator activated receptor binding protein |
| PPARD | | NM_006238 | 792 | NHR | peroxisome proliferative activated receptor, delta |
| PPARG | | NM_005037 | 793 | NHR | peroxisome proliferative activated receptor, gamma |
| PPARGC1 | | NM_013261 | 794 | Co-activator | peroxisome proliferative activated receptor, gamma, coactivator 1 |
| PRDM1 | | NM_001198 | 795 | Structural | PR domain containing 1, with ZNF domain |
| PRDM10 | | NM_020228 | 796 | Structural | PR domain containing 10 |
| PRDM11 | | NM_020229 | 797 | Structural | PR domain containing 11 |
| PRDM12 | | NM_021619 | 798 | Structural | PR domain containing 12 |
| PRDM13 | | NM_021620 | 799 | Structural | PR domain containing 13 |
| PRDM14 | | NM_024504 | 800 | Structural | PR domain containing 14 |
| PRDM15 | | NM_144771 | 801 | Structural | PR domain containing 15 |
| PRDM16 | | NM_022114 | 802 | Structural | PR domain containing 16 |
| PRDM2 | | NM_012231 | 803 | Structural | PR domain containing 2, with ZNF domain |
| PRDM4 | | NM_012406 | 804 | Structural | PR domain containing 4 |
| PRDM5 | | NM_018699 | 805 | Structural | PR domain containing 5 |
| PRDM6 | | AF272898 | 806 | Structural | PR domain containing 6 |
| PRDM7 | | AF274348 | 807 | Structural | PR domain containing 7 |
| PRDM8 | | NM_020226 | 808 | Structural | PR domain containing 8 |
| PROX1 | | NM_002763.3 | 809 | Homeobox | homeobox 1 |
| PRX2 | | NM_016307 | 810 | Homeobox | paired related homeobox protein |
| PSIP1 | | NM_021144.3 | 811 | Co-activator | PC4 and SFRS1 interacting protein 1 (isoforms 1-3) |
| | | NM_001128217.1 | 1487 | | |
| | | NM_033222.3 | 1488 | | |

TABLE 1-continued

Exemplary Human Transcription Factors

| Gene Abbrev | ScriptSureID | mRNA ID | SEQ ID NO: | Class | Description |
|---|---|---|---|---|---|
| PSMC2 | NT_007933:2739 | NM_002803 | 812 | Co-activator | proteasome (prosome, macropain) 26S subunit, ATPase, 2 |
| PSMC5 | | NM_002805 | 813 | Co-activator | proteasomes (prosome, macropain) 26S subunit, ATPase, 5 |
| PTF1A | NT_008705:1995 | NM_178161 | 814 | bHLH | pancreas specific transcription factor, 1a |
| PTTG1IP | | NM_004339 | 815 | Co-activator | pituitary tumor-transforming 1 interacting protein |
| PURA | | NM_005859 | 816 | Other | purine-rich element binding protein A |
| R28830_2 | | AC003682 | 817 | ZnF-Other | similar to ZNF197 (ZNF20) |
| R32184_3 | | NM_033420 | 818 | Other | hypothetical protein MGC4022 |
| RAI | | NM_006663 | 819 | Co-repressor | RelA-associated inhibitor |
| RAI15 | | U50383 | 820 | Other | retinoic acid induced 15 |
| RAA | | NM_000964 | 821 | NHR | retinoic acid receptor, alpha |
| RARB | | NM_000965 | 822 | NHR | retinoic acid receptor, beta |
| RARG | | NM_000966.4 NM_001042728.1 | 823 1489 | NHR | retinoic acid receptor, gamma (isoforms 1-2) |
| RAX | | NM_013435 | 824 | Homeobox | retina and anterior neural fold homeobox |
| RB1 | | NM_000321 | 825 | Pocket domain | retinoblastoma 1 (including osteosarcoma) |
| RBAF600 | | AB007931 | 826 | ZnF-C2H2 | retinoblastoma-associated factor 600 |
| RBAK | NT_007819:532 | NM_021163 | 827 | Other | RB-associated KRAB repressor |
| RBBP5 | | NM_005057 | 828 | Co-repressor | retinoblastoma binding protein 5 |
| RBBP9 | | NM_006606 | 829 | Co-repressor | retinoblastoma binding protein 9 |
| RBL1 | | NM_002895 | 830 | Pocket domain | retinoblastoma-like 1 (p107) |
| RBL2 | | NM_005611 | 831 | Pocket domain | retinoblastoma-like 2 (p130) |
| RBPSUH | | NM_016270 | 832 | ZnF-C2H2 | recombining binding protein suppressor of hairless (Drosophila) |
| RBPSUHL | | NM_014276 | 833 | Other | recombining binding protein suppressor of hairless-like (Drosophila) |
| RCOR | | NM_015156 | 834 | Other | REST corepressor |
| RCV1 | | NM_002903 | 835 | Other | recoverin |
| REL | | NM_002908 | 836 | Beta-scaffold-RHD | v-rel reticuloendotheliosis viral oncogene (avian) |
| REQ | | NM_006268 | 837 | ZnF-PHD | requiem, apoptosis response zinc finger gene |
| RERE | | NM_012102 | 838 | Other | arginine-glutamic acid dipeptide (RE) repeats |
| REST | | NM_005612 | 839 | ZnF-C2H2 | RE1-silencing transcription factor |
| TRIM27 | NT_033168:4 | NM_006510.4 | 840 | Structural | tripartite motif containing 27 |
| TRIM13 | | NM_005798.3 NM_052811.2 NM_213590.1 NM_001007278.1 | 841 1499 1500 136 | Structural | tripartite motif containing 13 (isoforms 1, 1, 1, and 2, respectively) |
| RFPL3 | NT_011520:1735 | NM_006604 | 842 | Structural | ret finger protein-like 3 |
| RFX1 | | NM_002918 | 843 | RFX | regulatory factor X, 1 (influences HLA class II expression) |
| RFX2 | | NM_000635 | 844 | RFX | regulatory factor X, 2 (influences HLA class II expression) |
| RFX3 | | NM_002919 | 845 | RFX | regulatory factor X, 3 (influences HLA class II expression) |

TABLE 1-continued

Exemplary Human Transcription Factors

| Gene Abbrev | ScriptSureID | mRNA ID | SEQ ID NO: | Class | Description |
|---|---|---|---|---|---|
| RFX4 | | NM_002920 | 846 | RFX | regulatory factor X, 4 (influences HLA class II expression) |
| RFX5 | | NM_000449 | 847 | RFX | regulatory factor X, 5 (influences HLA class II expression) |
| RFXANK | | NM_003721 | 848 | Co-activator | regulatory factor X-associated ankyrin-containing protein |
| RGC32 | | NM_014059 | 849 | Other | RGC32 protein |
| RIN3 | NT_026437:2459 | NM_024832 | 850 | bHLH | Ras and Rab interactor 3 |
| RING1 | | NM_002931 | 851 | ZnF-Other | ring finger protein 1 |
| RIP60 | | NM_013400 | 852 | ZnF-C2H2 | replication initiation region protein (60 kD) |
| RIPX | NT_006216:11 | NM_014961 | 853 | ZnF-PHD | rap2 interacting protein x |
| RLF | | NM_012421 | 854 | ZnF-C2H2 | rearranged L-myc fusion sequence |
| RNF10 | | NM_014868 | 855 | ZnF-Other | ring finger protein 10 |
| RNF12 | | NM_016120 | 856 | ZnF-Other | ring finger protein 12 |
| RNF 13 | | NM_007282 | 857 | ZnF-Other | ring finger protein 13 |
| RNF135 | NT_035420:144 | NM_032322 | 858 | ZnF-MIZ | ring finger protein 135 isoform 1 |
| RNF137 | NT_028310:82 | NM_018073 | 859 | Structural | ring finger protein 137 |
| RNF14 | | NM_004290 | 860 | Co-activator | ring finger protein 14 |
| RNF144 | | NM_014746 | 861 | ZnF-Other | Ring finger protein 144 |
| RNF18 | NT_033240:76 | NM_020358 | 862 | Structural | ring finger protein 18 |
| RNF2 | | NM_007212 | 863 | Co-repressor | ring finger protein 2 |
| RNF24 | | NM_007219 | 864 | ZnF-Other | ring finger protein 24 |
| RNF3 | | NM_006315 | 865 | ZnF-Other | ring finger protein 3 |
| RNF36 | NT_0101942 | NM_080745 | 866 | Structural | ring finger protein 36 |
| RNF4 | | NM_002938 | 867 | ZnF-Other | ring finger protein 4 |
| RNF8 | | NM_003958 | 868 | ZnF-Other | ring finger protein (C3HC4 type) 8 |
| RORA | | NM_134261.2 | 869 | — | RAR-related orphan receptor A (isoforms a-d) |
| | | NM_134260.2 | 1490 | | |
| | | NM_002943.3 | 1491 | | |
| | | NM_134262.2 | 1492 | | |
| RORB | | NM_006914.3 | 1493 | | RAR-related orphan receptor B |
| RORC | | NM_005060.3 | 1494 | | RAR-related orphan receptor C (isoforms a-b) |
| | | NM_001001523.1 | 1495 | | |
| RUNX1 | | NM_001754 | 870 | scaffold-RUNT | (acute myeloid leukemia 1; aml1 oncogene) |
| RUNX2 | | NM_004348 | 871 | Beta-scaffold-RUNT | runt-related transcription factor 2 |
| RUNX3 | | NM_004350 | 872 | Beta-scaffold-RUNT | runt-related transcription factor 3 |
| RXRA | | NM_002957 | 873 | NHR | retinoid X receptor, alpha |
| RXRB | | NM_021976 | 874 | NHR | retinoid X receptor, beta |
| RXRG | | NM_006917 | 875 | NHR | retinoid X receptor, gamma |
| RYBP | NT_005526:6 | NM_012234 | 876 | Co-repressor | RING1 and YY1 binding protein |
| SAFB | | NM_002967 | 877 | Other | scaffold attachment factor B |
| SALL1 | | NM_002968 | 878 | ZnF-C2H2 | sal-like 1 (*Drosophila*) |
| SALL2 | | AB002358 | 879 | ZnF-C2H2 | sal-like 2 (*Drosophila*) |
| SALL3 | | NM_171999 | 880 | ZnF-C2H2 | sal-like 3 (*Drosophila*) |
| SALL4 | | NM_020436 | 881 | ZnF-C2H2 | similar to SALL1 (sal (*Drosophila*)-like |
| SAP18 | | NM_005870 | 882 | Co-repressor | sin3-associated polypeptide, 18 kD |
| SAP30 | | NM_003864 | 883 | Co-repressor | sin3-associated polypeptide, 30 kD |
| SART3 | | NM_014706 | 884 | Co-activator | squamous cell carcinoma antigen recognized by T cells 3 |
| SATB1 | | NM_002971 | 885 | Homeobox | special AT-rich sequence binding protein 1 (binds to nuclear matrix/scaffold-associating DNAs) |
| SATB2 | NT_005037:10 | NM_015265 | 886 | Homeobox | SATB family member 2 |
| SBB103 | | NM_005785 | 887 | ZnF-Other | hypothetical SBB103 protein |
| SBLF | | NM_006873 | 888 | Other | stoned B-like factor |

TABLE 1-continued

Exemplary Human Transcription Factors

| Gene Abbrev | ScriptSureID | mRNA ID | SEQ ID NO: | Class | Description |
|---|---|---|---|---|---|
| SBZF3 | NT_031730:7 | NM_020394 | 889 | ZnF-C2H2 | zinc finger protein SBZF3 |
| SCA2 | | NM_002973 | 890 | Other | spinocerebellar ataxia 2 (Olivopontocerebellar ataxia 2, autosomal dominant, ataxin 2) |
| SCAND1 | | NM_016558 | 891 | Co-activator | SCAN domain-containing 1 |
| SCAND2 | | NM_022050 | 892 | Co-activator | SCAN domain-containing 2 |
| SCMH1 | NT_004852:374 | NM_012236 | 893 | Structural | sex comb on midleg homolog 1 (*Drosophila*) |
| SCML1 | | NM_006746 | 894 | Structural | sex comb on midleg-like 1 (*Drosophila*) |
| SCML2 | | NM_006089 | 895 | Structural | sex comb on midleg-like 2 (*Drosophila*) |
| SCML4 | NT_033944:303 | NM_198081 | 896 | Trp Cluster-Ets | sex comb on midleg-like 4 |
| SETDB1 | | NM_012432 | 897 | Structural | [cut off] bifurcated 1 |
| SF1 | | NM_004630 | 898 | ZnF-Other | splicing factor 1 |
| SHARP | | NM_015001 | 899 | Co-repressor | SMART/HDAC1 associated repressor protein |
| SHOX | | NM_000451.3 NM_006883.2 | 900 1496 | Homeobox | short stature homeobox (isoforms a-b) |
| SHOX2 | | NM_003030 | 901 | Homeobox | short stature homeobox 2 |
| SIAH1 | | NM_003031 | 902 | Co-repressor | seven in absentia homolog 1 (*Drosophila*) |
| SIAH2 | | NM_005067 | 903 | Co-repressor | seven in absentia homolog 2 (*Drosophila*) |
| SIM1 | | NM_005068 | 904 | bHLH | single-minded homolog 1 (*Drosophila*) |
| SIM2 | | NM_005069 | 905 | bHLH | single-minded homolog 2 (*Drosophila*) |
| SIN3B | | AB014600 | 906 | Co-activator | SIN3 homolog B, transcriptional regulator (yeast) |
| SIX1 | | NM_005982 | 907 | Homeobox | sine oculis homeobox homolog 1 (*Drosophila*) |
| SIX2 | | NM_016932 | 908 | Homeobox | sine oculis homeobox homolog 2 (*Drosophila*) |
| SIX3 | | NM_005413 | 909 | Homeobox | sine oculis homeobox homolog 3 (*Drosophila*) |
| SIX4 | | NM_017420 | 910 | Homeobox | sine oculis homeobox homolog 4 (*Drosophila*) |
| SIX5 | | X84813 | 911 | Homeobox | sine oculis homeobox homolog 5 (*Drosophila*) |
| SIX6 | | NM_007374 | 912 | Homeobox | sine oculis homeobox homolog 6 (*Drosophila*) |
| SLB | | AL110218 | 913 | Co-repressor | selective LIM binding factor |
| SLC2A4RG | NT_011333:173 | NM_020062 | 914 | ZnF-C2H2 | SLC2A4 regulator |
| SMARCA1 | | NM_003069 | 915 | Structural | SWI/SNF related, matrix associated, actin dependent regulator of chromatin, subfamily a, member 1 |
| SMARCA2 | | NM_003070 | 916 | Structural | SWI/SNF related, matrix associated, actin dependent regulator of chromatin, subfamily a, member 2 |
| SMARCA3 | | NM_003071 | 917 | Structural | SWI/SNF related, matrix associated, actin dependent regulator of chromatin, subfamily a, member 3 |
| SMARCA4 | | NM_003072 | 918 | Structural | SWI/SNF related, matrix associated, actin dependent regulator of chromatin, subfamily a, member 4 subfamily a-like 1 |
| SMARCB1 | | NM_003073 | 919 | Other | SWI/SNF related, matrix associated, actin dependent regulator of |

TABLE 1-continued

Exemplary Human Transcription Factors

| Gene Abbrev | ScriptSureID | mRNA ID | SEQ ID NO: | Class | Description |
|---|---|---|---|---|---|
| SMARCC1 | | NM_003074 | 920 | Structural | SWI/SNF related, matrix associated, actin dependent regulator of chromatin, subfamily b, member 1 |
| SMARCC2 | | NM_003075 | 921 | Structural | SWI/SNF related, matrix associated, actin dependent regulator of chromatin, subfamily c, member 1 |
| SMARCE1 | | NM_003079 | 922 | Structural | SWI/SNF related, matrix associated, actin dependent regulator of chromatin, subfamily c, member 2 |
| KDM5C | | NM_004187.3 | 923 | Structural | SWI/SNF related, matrix associated, actin dependent regulator of chromatin, subfamily e, member 1 |
| | | NM_001146702.1 | 924 | | lysine (K)-specific demethylase 5C |
| SNAI1 | | NM_005985 | 925 | ZnF-C2H2 | snail homolog 1 (*Drosophila*) |
| SNAI2 | | NM_003068 | 926 | ZnF-C2H2 | snail homolog 2 (*Drosophila*) |
| SNAI3 | | BC041461 | 927 | ZnF-C2H2 | snail homolog 3 (*Drosophila*) |
| SNAPC1 | | NM_003082 | 928 | Other | small nuclear RNA activating complex, polypeptide 1, 43 kDa |
| SNAPC2 | | NM_003083 | 929 | Other | small nuclear RNA activating complex, polypeptide 2, 45 kDa |
| SNAPC3 | | NM_003084 | 930 | Other | small nuclear RNA activating complex, polypeptide 3, 50 kDa |
| SNAPC4 | | NM_003086 | 931 | Other | small nuclear RNA activating complex, polypeptide 4, 190 kDa |
| SNAPC5 | | NM_006049 | 932 | Other | small nuclear RNA activating complex, polypeptide 5, 19 kDa |
| SNFT | | NM_018664 | 933 | bZIP | Jun dimerization protein p21SNFT |
| SNW1 | | NM_012245 | 934 | Co-activator | SKI-interacting protein |
| SOLH | NT_010552:127 | NM_005632 | 935 | ZnF-PHD | small optic lobes homolog (*Drosophila*) |
| SOM | NT_004391:39 | NM_021180 | 936 | Beta-scaffold-grainyhead | sister of mammalian grainyhead |
| SOX1 | | NM_005986 | 937 | Beta-scaffold-HMG | SRY (sex determining region Y)-box 1 |
| SOX10 | | NM_006941 | 938 | Beta-scaffold-HMG | SRY (sex determining region Y)-box 10 |
| SOX11 | | NM_003108 | 939 | Beta-scaffold-HMG | SRY (sex determining region Y)-box 11 |
| SOX18 | | NM_018419.2 | 940 | Beta-scaffold-HMG | SRY (sex determining region Y)-box 18 |
| SOX2 | | L07335 | 941 | Beta-scaffold-HMG Seed SRY | (sex determining region Y)-box 2 |
| SOX21 | | NM_007084 | 942 | Beta-Scaffold-HMG | SRY (Sex determining region Y)-box 21 |
| SOX3 | | NM_005634 | 943 | Beta-Scaffold-HMG | SRY (sex determining region Y)-box 3 |
| SOX30 | | NM_007017 | 944 | Beta-scaffold-HMG | SRY (sex determining region Y)-box 30 |
| SOX4 | | NM_003107 6659 | 945 | Beta-scaffold-HMG | SRY (sex determining region Y)-box 4 |
| SOX5 | | NM_006940 6660 | 946 | Beta-scaffold-HMG | SRY (sex determining region Y)-box 5 |
| SOX6 | | NM_033326 55553 | 947 | Beta-scaffold-HMG | SRY (sex determining region Y)-box 6 |
| SOX7 | NT_008010:24 | NM_031439 | 948 | Beta-scaffold-HMG | SRY (sex determining region Y)-box 7 |

TABLE 1-continued

Exemplary Human Transcription Factors

| Gene Abbrev | ScriptSureID | mRNA ID | SEQ ID NO: | Class | Description |
|---|---|---|---|---|---|
| SOX8 | | NM_014587 30812 | 949 | Beta-scaffold-HMG | SRY (sex determining region Y)-box 8 |
| SOX9 | | NM_000346 6662 | 950 | Beta-scaffold-HMG | SRY (sex determining region Y)-box 9 |
| SP1 | | J03133 | 951 | ZnF-C2H2 | Sp1 transcription factor |
| SP100 | NT_005403:864 | NM_003113 | 952 | Beta-scaffold-HMG | nuclear antigen Sp100 |
| SP2 | | NM_003110 | 953 | ZnF-C2H2 | Sp2 transcription factor |
| SP3 | | X68560 | 954 | ZnF-C2H2 | Sp3 transcription factor |
| SP4 | | NM_003112 | 955 | ZnF-C2H2 | Sp4 transcription factor |
| SP7 | NT_009563:27 | NM_152860 | 956 | ZnF-C2H2 | Sp7 transcription factor |
| SPI1 | | NM_003120 | 957 | Trp cluster-Ets | spleen focus forming virus (SFFV) proviral integration oncogene spi1 |
| SPIB | | NM_003121 | 958 | Trp cluster-Ets | Spi-B transcription factor (Spi-1/PU.1 related) |
| SPIC | NT_009743:37 | NM_152323 | 959 | Trp Cluster-Ets | likely ortholog of mouse Spi-C transcription factor (Spi-1/PU.1 related) |
| SRA1 | | AF293024 | 960 | Co-activator | steroid receptor RNA activator 1 |
| SRCAP | | NM_006662 | 961 | Structural | Snf2-related CBP activator protein |
| SREBF1 | | NM_004176 | 962 | bHLH | sterol regulatory element binding transcription factor 1 |
| SREBF2 | | NM_004599 | 963 | bHLH | sterol regulatory element binding transcription factor 2 |
| SRF | | NM_003131 | 964 | Beta-scaffold-MADS | serum response factor (c-fos serum response element-binding transcription factor) |
| SRY | | NM_003140 | 965 | Beta-scaffold-HMG | sex determining region Y |
| SSA1 | NT_028310:75 | NM_003141 | 966 | Structural | Sjogren syndrome antigen A1 (52 kDa, ribonucleoprotein autoantigen SS-A/Ro) |
| SSRP1 | | NM_003146 | 967 | Co-activator | structure specific recognition protein 1 |
| SSX1 | | NM_005635 | 968 | Other | synovial sarcoma, X breakpoint 1 |
| SSX2 | | NM_003147 | 969 | Other | synovial sarcoma, X breakpoint 2 |
| SSX3 | | NM_021014 | 970 | Other | synovial sarcoma, X breakpoint 3 |
| SSX4 | | NM_005636 | 971 | Other | synovial sarcoma, X breakpoint 4 |
| SSX5 | | NM_021015 | 972 | Other | synovial sarcoma, X breakpoint 5 |
| SSX6 | | NM_173357 | 973 | Other | synovial sarcoma, X breakpoint 6 |
| SSX7 | | NM_173358 | 974 | Other | synovial sarcoma, X breakpoint 7 |
| SSX8 | | NM_174961 | 975 | Other | synovial sarcoma, X breakpoint 8 |
| SSX9 | | NM_174962 | 976 | Other | synovial sarcoma, X breakpoint 9 |
| ST18 | | NM_014682 | 977 | ZnF-C3H | suppression of tumorigenicity 18 (breast carcinoma) (zinc finger protein) |
| STAT1 | | NM_007315 | 978 | Beta-scaffold-STAT | signal transducer and activator of transcription 1, 91 kDa |
| STAT2 | | NM_005419 | 979 | Beta-scaffold-STAT | signal transducer and activator of transcription 2, 113 kDa |
| STAT3 | | NM_003150 | 980 | Beta-scaffold-STAT | signal transducer and activator of transcription 3 (acute-phase response factor) |

TABLE 1-continued

Exemplary Human Transcription Factors

| Gene Abbrev | ScriptSureID | mRNA ID | SEQ ID NO: | Class | Description |
|---|---|---|---|---|---|
| STAT4 | | NM_003151 | 981 | Beta-scaffold-STAT | signal transducer and activator of transcription 4 |
| STAT5A | | NM_003152 | 982 | Beta-scaffold-STAT | signal transducer and activator of transcription 5A |
| STAT5B | | NM_012448 | 983 | Beta-scaffold-STAT | signal transducer and activator of transcription 5B |
| STAT6 | | NM_003153 | 984 | Beta-scaffold-STAT | signal transducer and activator of transcription 6, interleukin-4 induced |
| SUPT16H | | NM_007192 | 985 | Other | suppressor of Ty 16 homolog (*S. cerevisiae*) |
| SUPT3H | | NM_003599 | 986 | Other | suppressor of Ty 3 homolog (*S. cerevisiae*) |
| SUPT4H1 | | NM_003168 | 987 | Other | suppressor of Ty 4 homolog (*S. cerevisiae*) |
| SUPT5H | | NM_003169 | 988 | Dwarfin | suppressor of Ty 5 homolog (*S. cerevisiae*) |
| SUPT6H | | NM_003170 | 989 | Other | suppressor of Ty 6 homolog (*S. cerevisiae*) |
| SURB7 | | NM_004264 | 990 | Other | SRB7 suppressor of RNA polymerase B homolog (yeast) |
| SUV39H1 | NT_011568:277 | NM_003173 | 991 | Structural | suppressor of variegation 3-9 homolog 1 (*Drosophila*) |
| SZF1: | NT_022567:166 | NM_016089 | 992 | ZnF-C2H2 | KRAB-zinc finger protein SZF1-1 |
| SZFP41 | NT_011192:184 | NM_152279 | 993 | ZnF-C2H2 | zinc finger protein 41-like |
| T | | NM_003181 | 994 | T-box | T, brachyury homolog (mouse) |
| TADA2L | | NM_001488 | 995 | Other | transcriptional adaptor 2 (ADA2 homolog, yeast)-like |
| TADA3L | | NM_006354 | 996 | Other | transcriptional adaptor 3 (ADA3 homolog, yeast)-like |
| TAF1 | | NM_004606 | 997 | Other | TAF1 RNA polymerase II, TATA box binding protein (TBP)-associated factor, 250 kDa |
| TAF10 | | NM_006284 | 998 | Other | TAF10 RNA polymerase II, TATA box binding protein (TBP)-associated factor, 30 kDa |
| TAF11 | | NM_005643 | 999 | Other | TAF11 RNA polymerase II, TATA box binding protein (TBP)-associated factor, 28 kDa |
| TAF12 | | NM_005644 | 1000 | Other | TAF12 RNA polymerase II, TATA box binding protein (TBP)-associated factor, 20 kDa |
| TAF13 | | NM_005645 | 1001 | Other | TAF13 RNA polymerase II, TATA box binding protein (TBP)-associated factor, 18 kDa |
| TAF15 | | NM_003487 | 1002 | Other | TAF15 RNA polymerase II, TATA box binding protein (TBP)-associated factor, 68 kDa |
| TAF1A | | NM_005681 | 1003 | Other | TATA box binding protein (TBP)-associated factor, RNA polymerase I, A, 48 kDa |
| TAF1B | | L39061 | 1004 | Other | TATA box binding protein (TBP)-associated factor, RNA polymerase 1, B, 63 kDa |
| TAF1C | | NM_005679 | 1005 | Other | TATA box binding protein (TBP)-associated factor, RNA polymerase I, C, 110 kDa |

TABLE 1-continued

Exemplary Human Transcription Factors

| Gene Abbrev | ScriptSureID | mRNA ID | SEQ ID NO: | Class | Description |
|---|---|---|---|---|---|
| TAF2 | | NM_003184 | 1006 | Other | TAF2 RNA polymerase II, TATA box binding protein (TBP)-associated factor, 150 kDa |
| TAF3 | | AJ292190 | 1007 | Other | TAF3 RNA polymerase II, TATA box binding protein (TBP)-associated factor, 140 kDa |
| TAF4 | | NM_003185 | 1008 | Other | TAF4 RNA polymerase II, TATA box binding protein (TBP)-associated factor, 135 kDa |
| TAF4B | | Y09321 | 1009 | Other | TAF4b RNA polymerase II, TATA box binding protein (TBP)-associated factor, 80 kDa |
| TAF6L | | NM_006473 | 1010 | Co-activator | TAF6-like RNA polymerase II, p300/CBP-associated factor (PCAF)-associated factor, 65 kDa |
| TAF7 | | NM_005642 | 1011 | Other | TAF7 RNA polymerase II, TATA box binding protein (TBP)-associated factor, 55 kDa |
| TAF9 | | NM_003187 | 1012 | Other | TAF9 RNA polymerase II, TATA box binding protein (TBP)-associated factor, 32 kDa |
| TAL1 | | NM_003189 | 1013 | bHLH | T-cell acute lymphocytic leukemia 1 |
| TAL2 | | NM_005421 | 1014 | bHLH | T-cell acute lymphocytic leukemia 2 |
| TBP | | NM_003194 | 1015 | Other | TATA box binding protein |
| TBPL1 | | NM_004865 | 1016 | Other | TBP-like 1 |
| TBR1 | | NM_006593 | 1017 | T-box | T-box, brain, 1 |
| TBX1 | | NM_005992 | 1018 | T-box | T-box 1 |
| TBX10 | | AF033579 | 1019 | T-box | T-box 10 |
| TBX15 | | NM_152380 | 1020 | T-box | T-box 15 |
| TBX18 | | AJ010278 | 1021 | T-box | T-box 18 |
| TBX19 | | NM_005149 | 1022 | T-box | T-box 19 |
| TBX2 | | NM_005994 | 1023 | T-box | T-box 2 |
| TBX20 | | AJ237589 | 1024 | T-box | T-box 20 |
| TBX21 | | NM_013351 | 1025 | T-box | T-box 21 |
| TBX22 | | NM_016954 | 1026 | T-box | T-box 22 |
| TBX3 | | NM_005996 | 1027 | T-box | T-box 3 (ulnar mammary syndrome) |
| TBX4 | | NM_018488 | 1028 | T-box | T-box 4 |
| TBX5 | | NM_000192 | 1029 | T-box | T-box 5 |
| TBX6 | | NM_004608 | 1030 | T-box | T-box 6 |
| TCEAL1 | | NM_004780 | 1031 | ZnF-Other | transcription elongation factor A (SII)-like 1 |
| TCERG1 | | NM_006706 | 1032 | Other | transcription elongation regulator 1 (CA150) |
| TCF1 | | NM_000545 | 1033 | Homeobox | transcription factor 1, hepatic; LF-B1, hepatic nuclear factor (HNF1), albumin proximal factor |
| TCF12 | | NM_003205 | 1034 | bHLH | transcription factor 12 (HTF4, helix-loop-helix transcription factors 4) |
| TCF15 | | NM_004609 | 1035 | bHLH | transcription factor 15 (basic helix-loop-helix) |
| TCF19 | | NM_007109 | 1036 | Other | transcription factor 19 (SC1) |
| TCF7 | | NM_003202 | 1037 | scaffold-HMG | transcription factor 2, (T-cell specific, HMG-box) |
| TCF7L1 | | X62870 | 1038 | Beta-scaffold-HMG | transcription factor 7-like 1 (T-cell specific, HMG-box) |
| TCF7L2 | | NM_030756 | 1039 | Beta-scaffold-HMG | transcription factor 7-like 2 (T-cell specific, HMG-box) |

TABLE 1-continued

Exemplary Human Transcription Factors

| Gene Abbrev | ScriptSureID | mRNA ID | SEQ ID NO: | Class | Description |
|---|---|---|---|---|---|
| TCF8 | | NM_030751 | 1040 | ZnF-C2H2 | transcription factor 8 (represses interleukin 2 expression) |
| TCFL1 | | NM_005997 | 1041 | Other | transcription factor-like 1 |
| TCFL4 | | NM_013383 | 1042 | bHLH | transcription factor-like 4 |
| TCFL5 | | NM_006602 | 1043 | bHLH | transcription factor-like 5 (basic helix-loop-helix) |
| TEAD1 | | NM_021961 | 1044 | TEA | TEA domain family member 1 (SV40 transcriptional enhancer factor) |
| TEAD2 | | NM_003598 | 1045 | TEA | TEA domain family member 2 |
| TEAD3 | | NM_003214 | 1046 | TEA | TEA domain family member 3 |
| TEAD4 | | NM_003213 | 1047 | TEA | TEA domain family member 4 |
| TEF | | NM_003216 | 1048 | bZIP | thyrotrophic embryonic factor |
| TEL2 | | NM_016135 | 1049 | Trp cluster-Ets | ets transcription factor TEL2 |
| TEX27 | | NM_021943 | 1050 | ZnF-AN1 | testis expressed sequence 27 |
| TFAM | | NM_012251 | 1051 | Beta-scaffold-HMG | transcription factor A, mitochondrial |
| TFAP2A | | NM_003220 | 1052 | AP-2 | transcription factor AP-2 alpha (activating enhancer binding protein 2 alpha) |
| TFAP2B | | NM_003221 | 1053 | AP-2 | transcription factor AP-2 beta (activating enhancer binding protein 2 beta) |
| TFAP2BL1 | | NM_172238 | 1054 | AP-2 | transcription factor AP-2 beta (activating enhancer binding protein 2 beta)-like 1 |
| TFAP2C | | NM_003222 | 1055 | AP-2 | transcription factor AP-2 gamma (activating enhancer binding protein 2 gamma) |
| TFAP4 | | NM_003223 | 1056 | bHLH | transcription factor AP-4 (activating enhancer binding protein 4) |
| TFB1M | | NM_016020 | 1057 | Other | transcription factor B1, mitochondrial |
| TFB2M | | NM_022366 | 1058 | Other | transcription factor B2, mitochondrial |
| TFCP2 | | NM_005653 | 1059 | Beta-scaffold-grainyhead | transcription factor CP2 |
| TFE3 | | NM_006521 | 1060 | bHLH | transcription factor binding to IGHM enhancer 3 |
| TFEB | | BC006225 | 1061 | bHLH | transcription factor EB |
| TFEC | | NM_012252 | 1062 | bHLH | transcription factor EC |
| TGFB1I1 | | NM_015927 | 1063 | Co-activator | transforming growth factor beta 1 induced transcript 1 |
| TGIF | | NM_003244 | 1064 | Homeobox | TGFB-induced factor (TALE family homeobox) |
| THG-1 | | AJ133115 | 1065 | bZIP | TSC-22-like |
| THRA | | NM_003250 | 1066 | NHR | thyroid hormone receptor, alpha (erythroblastic leukemia viral (v-erb-a) oncogene homolog, avian) |
| THRAP4 | | NM_014815 | 1067 | Co-activator | thyroid hormone receptor associated protein 4 |
| THRB | | NM_000461 | 1068 | NHR | thyroid hormone receptor, beta (erythroblastic leukemia viral (v-erb-a) oncogene homolog 2, avian) |
| TIEG | | NM_005655 | 1069 | ZnF-C2H2 | TGFB inducible early growth response |
| TIEG2 | | NM_003597 | 1070 | ZnF-C2H2 | TGFB inducible early growth response 2 |

TABLE 1-continued

Exemplary Human Transcription Factors

| Gene Abbrev | ScriptSureID | mRNA ID | SEQ ID NO: | Class | Description |
|---|---|---|---|---|---|
| TIF1 | | NM_003852 | 1071 | Structural | transcriptional intermediary factor 1 |
| TIMELESS | | NM_003920 | 1072 | Other | timeless homolog (*Drosophila*) |
| TIP120A | | NM_018448 | 1073 | Co-activator | TBP-interacting protein |
| TITF1 | | NM_003317 | 1074 | Homeobox | thyroid transcription factor 1 |
| TIX1 | | AB007855 | 1075 | Homeobox | triple homeobox 1 |
| TIZ | NT_033317:106 | NM_138330 | 1076 | ZnF-C2H2 | TRAF6-inhibitory zinc finger protein |
| TLX1 | | NM_005521 | 1077 | Homeobox | T-cell leukemia, homeobox 1 |
| TLX2 | | NM_001534 | 1078 | Homeobox | T-cell leukemia, homeobox 2 |
| TLX3 | | NM_021025 | 1079 | Homeobox | T-cell leukemia, homeobox 3 |
| TMF1 | | NM_007114 | 1080 | Other | TATA element modulatory factor 1 |
| TNRC11 | | NM_005120 | 1081 | Co-activator | trinucleotide repeat containing 11 (THR-associated protein, 230 kDa subunit) |
| TNRC17 | | U80752.1 | 1082 | Other | trinucleotide repeat containing 17 |
| TNRC18 | | U80753 | 1083 | Other | trinucleotide repeat containing 18 |
| TNRC21 | | U80756 | 1084 | Other | trinucleotide repeat containing 21 |
| TNRC3 | | NM_005878 | 1085 | Other | trinucleotide repeat containing 3 |
| TP53 | | NM_000546 | 1086 | Beta-scaffold-p53 | tumor protein P53 (Li-Fraumeni syndrome) |
| TP53BP2 | NT_004525:42 | NM_005426 | 1087 | Co-repressor | tumor protein p53 binding protein, 2 |
| TP63 | | NM_003722 | 1088 | Beta-scaffold-p53 | tumor protein p63 |
| TP73 | | NM_005427 | 1089 | Beta-scaffold-p53 | tumor protein p73 |
| TRAP150 | | NM_005119 | 1090 | Co-activator | thyroid hormone receptor-associated protein, 150 kDa subunit |
| TRAP95 | | NM_005481 | 1091 | Co-activator | thyroid hormone receptor-associated protein, 95-kD subunit |
| TRERF1 | NT_007592:3400 | NM_018415 | 1092 | ZnF-C2H2 | transcriptional regulating factor 1 |
| TRIM10 | | NM_006778 | 1093 | Structural | tripartite motif-containing 10 |
| TRIM14 | NT_033216:170 | NM_014788 | 1094 | Structural | tripartite motif-containing 14 |
| TRIM15 | | NM_033229 | 1095 | Structural | tripartite motif-containing 15 |
| TRIM16 | NT_010718:517 | NM_006470 | 1096 | Structural | tripartite motif-containing 16 |
| TRIM17 | NT_004908:93 | NM_016102 | 1097 | Structural | tripartite motif-containing 17 |
| TRIM22 | | NM_006074 | 1098 | Structural | tripartite motif-containing 22 |
| TRIM26 | | NM_003449 | 1099 | Structural | tripartite motif-containing 26 |
| TRIM28 | | NM_005762 | 1100 | Structural | tripartite motif-containing 28 |
| TRIM29 | NT_033899:65 | NM_012101 | 1101 | Structural | tripartite motif-containing 29 |
| TRIM3 | | NM_006458 | 1102 | ZnF-Other | tripartite motif-containing 3 |
| TRIM31 | NT_034873:26 | NM_007028 | 1103 | Structural | tripartite motif-containing 31 |
| TRIM33 | | NM_015906 | 1104 | Structural | tripartite motif-containing 33 |
| TRIM34 | NT_03508:27a | NM_021616 | 1105 | Structural | tripartite motif-containing 34 |
| TRIM35 | NT_007988:5 | NM_015066 | 1106 | Structural | tripartite motif-containing 35 |
| TRIM38 | | NM_006355 | 1107 | ZnF-Other | tripartite motif-containing 38 |

TABLE 1-continued

Exemplary Human Transcription Factors

| Gene Abbrev | ScriptSureID | mRNA ID | SEQ ID NO: | Class | Description |
|---|---|---|---|---|---|
| TRIM39 | NT_033951:12 | NM_021253 | 1108 | Structural | tripartite motif-containing 39 |
| TRIM4 | NT_007933:2024 | NM_033017 | 1109 | Structural | tripartite motif-containing 4 |
| TRIM40 | NT_007592:1918 | NM_138700 | 1110 | Structural | tripartite motif-containing 40 |
| TRIM41 | NT_006519:206 | NM_201627 | 1111 | Structural | tripartite motif-containing 41 |
| TRIM47 | NT_033292:11 | NM_033452 | 1112 | Structural | tripartite motif-containing 47 |
| TRIM48 | NT_033903:1 | NM_024114 | 1113 | Structural | tripartite motif-containing 48 |
| TRIM5 | NT_035080:27b | NM_033034 | 1114 | Structural | tripartite motif-containing 5 |
| TRIP11 | | NM_004239 | 1115 | Co-activator | thyroid hormone receptor interactor 11 |
| TRIP11 | | NM_004237 | 1116 | Co-activator | thyroid hormone receptor interactor 13 |
| TRIP15 | | NM_004236 | 1117 | Co-activator | thyroid receptor interacting protein 15 |
| TRIP4 | | NM_016213 | 1118 | Co-activator | thyroid hormone receptor interactor 4 |
| TRIP6 | | L40374 | 1119 | Co-activator | thyroid hormone receptor interactor 6 |
| TRIP8 | NT_008583:38 | NM_004241 | 1120 | Jumonji | thyroid hormone receptor interactor 8 |
| TRIP-Br2 | | NM_014755 | 1121 | Co-activator | transcriptional regulator interacting with the PHS-bromodomain 2 |
| TRPS1 | | NM_014112 | 1122 | ZnF-Other | trichorhinophalangeal syndrome I |
| TSC22 | | NM_006022 | 1123 | bZIP | transforming growth factor beta-stimulated protein TSC-22 |
| TUB | | NM_003320 | 1124 | Tubby | tubby homolog (mouse) |
| TULP1 | | NM_003322 | 1125 | Tubby | tubby like protein 1 |
| TULP2 | | NM_003323 | 1126 | Tubby | tubby like protein 2 |
| TULP3 | | NM_003324 | 1127 | Tubby | tubby like protein 3 |
| TULP4 | | NM_020245 | 1128 | Tubby | tubby like protein 4 |
| TWIST | | NM_000474 | 1129 | bHLH | Twist |
| TZFP | | NM_014383 | 1130 | ZnF-BTB/POZ | testis zinc finger protein |
| UBP1 | | NM_014517 | 1131 | Beta-scaffold-grainyhead | upstream binding protein 1 (LBP-1a) |
| UBTF | | NM_014233 | 1132 | Beta-scaffold-HMG | upstream binding transcription factor, RNA polymerase 1 |
| UHRF1 | | NM_013282 | 1133 | ZnF-PHD | ubiquitin-like, containing PHD and RING finger |
| URF2 | NT_008413:704 | NM_152306 | 1134 | ZnF-PHD | ubiquitin-like, containing PHD and RING finger domains 2 |
| USF1 | | NM_007122 | 1135 | bHLH | upstream transcription factor 1 |
| USF2 | | NM_003367 | 1136 | bHLH | upstream transcription factor 2, c-fos interacting |
| UTF1 | | NM_003577 | 1137 | bZIP | undifferentiated embryonic cell transcription factor 1 |
| VAX1 | | NM_199131 | 1138 | Homeobox | ventral anterior homeobox 1 |
| VAX2 | | NM_012476 | 1139 | Homeobox | ventral anterior homeobox 2 |
| VDR | | NM_000376 | 1140 | NHR | vitamin D (1,25-dihydroxyvitamin D3) receptor |
| VENTX2 | | NM_014468 | 1141 | Homeobox | VENT-like homeobox 2 |
| VIK | NT_007933:1990 | NM_024061 | 1142 | ZnF-C2H2 | vav-1 interacting Kruppel-like protein |
| cutoff | | | | | |
| YAF2 | | NM_005748 | 1143 | Co-repressor | YY1 associated factor 2 |
| YBX2 | | NM_015982 | 1144 | Beta-scaffold-cold-shock | germ cell specific Y-box binding protein |
| YY1 | | NM_003403 | 1145 | ZnF-C2H2 | YY1 transcription factor |
| ZAR1 | | NM_175619 | 1146 | Other | zygote arrest 1 |
| ZBTB1 | NT_025892:3338 | BC050719 | 1147 | ZnF-BTB/POZ | zinc finger and BTB domain containing 1 |

TABLE 1-continued

Exemplary Human Transcription Factors

| Gene Abbrev | ScriptSureID | mRNA ID | SEQ ID NO: | Class | Description |
|---|---|---|---|---|---|
| ZBTB2 | NT_023451:235 | NM_020861 | 1148 | ZnF-BTB/POZ | zinc finger and BTB domain containing 2 |
| ZBTB4 | NT_035416:6 | NM_020899 | 1149 | ZnF-C2H2 | zinc finger and BTB domain containing 4 |
| ZDHHC1 | | U90653 | 1150 | ZnF-Other | zinc finger, DHHC domain containing 1 |
| ZF | | NM_021212 | 1151 | bZIP | HCF-binding transcription factor Zhangfei |
| ZF5128 | | NM_014347 | 1152 | ZnF-C2H2 | zinc finger protein |
| ZFD25 | | NM_016220 | 1153 | ZnF-C2H2 | zinc finger protein (ZFD25) |
| ZFH4 | NT_008055:104 | NM_024721 | 1154 | ZnF-C2H2 | zinc finger homeodomain 4 |
| ZFHX1B | | NM_014795 | 1155 | ZnF-C2H2 | zinc finger homeobox 1B |
| ZFHX2 | | AB051549 | 1156 | Homeobox | zinc finger homeobox 2 |
| ZFP | | NM_018651 | 1157 | ZnF-C2H2 | zinc finger protein |
| ZFP1 | NT_035368:196 | NM_153688 | 1158 | ZnF-C2H2 | zinc finger protein homolog |
| ZFP100 | | AL080143 | 1159 | ZnF-C2H2 | zinc finger protein |
| ZFP103 | | NM_005677 | 1160 | ZnF-Other | zinc finger protein 103 homolog (mouse) |
| ZFP106 | | NM_022473 | 1161 | ZnF-C2H2 | zinc finger protein 106 |
| ZFP161 | | NM_003409 | 1162 | ZnF-BTB/POZ | zinc finger protein 161 homolog (mouse) |
| ZFP26 | | NM_016422 | 1163 | ZnF-Other | C3HC4-like zinc finger protein |
| ZFP276 | NT_010542:164 | NM_152287 | 1164 | ZnF-C2H2 | zinc finger protein 276 homolog |
| ZFP28 | | AB037852 | 1165 | ZnF-C2H2 | zinc finger protein 28 homolog (mouse) |
| ZFP289 | | NM_032389 | 1166 | ZnF-Other | Seed zinc finger protein 289, ID1 regulated |
| ZFP29 | | NM_017894 | 1167 | ZnF-C2H2 | likely ortholog of mouse zinc finger protein 29 |
| ZFP318 | | NM_014345 | 1168 | ZnF-Other | Seed endocrine regulator |
| ZFP36 | | NM_003407 | 1169 | ZnF-C3H | zinc finger protein 36, C3H type, homolog (mouse) |
| ZFP37 | | NM_003408 | 1170 | ZnF-C2H2 | zinc finger protein 37 homolog (mouse) |
| ZFP42 | NT_022841:73 | NM_174900 | 1171 | ZnF-C2H2 | Found zinc finger protein 42 |
| ZFP64 | | NM_018197 | 1172 | ZnF-C2H2 | Seed zinc finger protein 64 homolog (mouse) |
| ZFP67 | | NM_015872 | 1173 | ZnF-BTB/POZ | Seed zinc finger protein 67 homolog (mouse) |
| ZFP91 | | AB056107 | 1174 | ZnF-C2H2 | zinc finger protein 91 homolog (mouse) |
| ZFP92 | | U82695 | 1175 | ZnF-Other | zinc finger protein 92 homolog (mouse) |
| ZFP95 | | NM_014569 | 1176 | ZnF-C2H2 | zinc finger protein 95 homolog (mouse) |
| ZFPL1 | | NM_006782 | 1177 | ZnF-PHD | zinc finger protein-like 1 |
| ZFPM1 | | NM_153813 | 1178 | ZnF-C2H2 | zinc finger protein, multitype 1 (FOG1) |
| ZFPM2 | | NM_012082 | 1179 | ZnF-C2H2 | zinc finger protein, multitype 2 (FOG2) |
| ZFR | | NM_016107 | 1180 | ZnF-C2H2 | zinc finger RNA binding protein |
| ZFX | | NM_003410 | 1181 | ZnF-C2H2 | zinc finger protein, X-linked |
| ZFY | | NM_003411 | 1182 | ZnF-C2H2 | zinc finger protein, Y-linked |
| ZHX1 | | NM_007222 | 1183 | Homeobox | zinc-fingers and homeoboxes 1 |
| ZHX2 | NT_023663:37 | NM_014943 | 1184 | Homeobox | zinc fingers and homeoboxes 2 |
| ZIC1 | | NM_003412 | 1185 | ZnF-C2H2 | Zic family member 1 (odd-paired homolog, *Drosophila*) |
| ZIC2 | | NM_007129 | 1186 | ZnF-C2H2 | Zic family member 2 (odd-paired homolog, *Drosophila*) |

TABLE 1-continued

Exemplary Human Transcription Factors

| Gene Abbrev | ScriptSureID | mRNA ID | SEQ ID NO: | Class | Description |
|---|---|---|---|---|---|
| ZIC3 | | NM_003413 | 1187 | ZnF-C2H2 | Zic family member 3 heterotaxy 1 (odd-paired homolog, *Drosophila*) |
| ZIC4 | | NM_032153 | 1188 | ZnF-C2H2 | zinc finger protein of the cerebellum 4 |
| ZIC5 | | NM_033132 | 1189 | ZnF-C2H2 | zinc finger protein of the cerebellum 5 |
| ZID | | NM_006626 | 1190 | ZnF-BTB/POZ | zinc finger protein with interaction domain |
| ZIM2 | | NM_015363 | 1191 | ZnF-C2H2 | zinc finger, imprinted 2 |
| ZIM3 | NT_011104:125 | NM_052882 | 1192 | ZnF-C2H2 | zinc finger, imprinted 3 |
| ZNF10 | | NM_003419 | 1193 | ZnF-C2H2 | zinc finger protein 10 (KOX 1) |
| ZNF100 | NT_035560:167 | NM_173531 | 1194 | ZnF-C2H2 | zinc finger protein 100 |
| ZNF117 | | NM_024498 | 1195 | ZnF-C2H2 | zinc finger protein 117 (HPF9) |
| ZNF11A | | X68686 | 1196 | ZnF-C2H2 | zinc finger protein 11a (KOX 2) |
| ZNF11B | | X68684 | 1197 | ZnF-C2H2 | zinc finger protein 11b (KOX 2) |
| ZNF123 | | S52506 | 1198 | ZnF-C2H2 | zinc finger protein 123 (HZF-1) |
| ZNF124 | | NM_003431 | 1199 | ZnF-C2H2 | zinc finger protein 124 (HZF-16) |
| ZNF125 | | S52508 | 1200 | ZnF-C2H2 | zinc finger protein 125 (HZF-3) |
| ZNF126 | | S52507 | 1201 | ZnF-C2H2 | zinc finger protein 126 (HZF-2) |
| ZNF131 | | U09410 | 1202 | ZnF-C2H2 | zinc finger protein 131 (clone pHZ-10) |
| ZNF132 | | NM_003433 | 1203 | ZnF-C2H2 | zinc finger protein 132 (clone pHZ-12) |
| ZNF133 | | NM_003434 | 1204 | ZnF-C2H2 | zinc finger protein 133 (clone pHZ-13) |
| ZNF134 | | NM_003435 | 1205 | ZnF-C2H2 | zinc finger protein 134 (clone pHZ-15) |
| ZNF135 | | NM_003436 | 1206 | ZnF-C2H2 | zinc finger protein 135 (clone pHZ-17) |
| ZNF136 | | NM_003437 | 1207 | ZnF-C2H2 | zinc finger protein 136 (clone pHZ-20) |
| ZNF137 | | NM_003438 | 1208 | ZnF-C2H2 | zinc finger protein 137 (clone pHZ-30) |
| ZNF138 | | U09847 | 1209 | ZnF-C2H2 | zinc finger protein 138 (clone pHZ-32) |
| ZNF14 | | NM_021030 | 1210 | ZnF-C2H2 | zinc finger protein 14 (KOX 6) |
| ZNF140 | | NM_003440 | 1211 | ZnF-C2H2 | zinc finger protein 140 (clone pHZ-39) |
| ZNF141 | | NM_003441 | 1212 | ZnF-C2H2 | zinc finger protein 141 (clone pHZ-44) |
| ZNF142 | | NM_005081 | 1213 | ZnF-C2H2 | zinc finger protein 142 (clone pHZ-49) |
| ZNF143 | | NM_003442 | 1214 | ZnF-C2H2 | zinc finger protein 143 (clone pHZ-1) |
| ZNF144 | | NM_007144 | 1215 | ZnF-Other | zinc finger protein 144 (Mel-18) |
| ZNF145 | | NM_006006 | 1216 | ZnF-BTB/POZ | zinc finger protein 145 (Kruppel-like, expressed in promyelocytic leukemia) |
| ZNF146 | | NM_007145 | 1217 | ZnF-C2H2 | zinc finger protein 146 |
| ZNF147 | | NM_005082 | 1218 | Structural | zinc finger protein 147 (estrogen-responsive finger protein) |
| ZNF148 | | NM_021964 | 1219 | ZnF-C2H2 | zinc finger protein 148 (pHZ-52) |
| ZNF151 | | NM_003443 | 1220 | ZnF-BTB/POZ | zinc finger protein 151 (pHZ-67) |
| ZNF154 | | U20648 | 1221 | ZnF-C2H2 | zinc finger protein 154 (pHZ-92) |
| ZNF155 | | NM_003445 | 1222 | ZnF-C2H2 | zinc finger protein 155 (pHZ-96) |
| ZNF157 | | NM_003446 | 1223 | ZnF-C2H2 | zinc finger protein 157 (HZF22) |

TABLE 1-continued

Exemplary Human Transcription Factors

| Gene Abbrev | ScriptSureID | mRNA ID | SEQ ID NO: | Class | Description |
|---|---|---|---|---|---|
| ZNF15L1 | | X52339 | 1224 | ZnF-C2H2 | zinc finger protein 15-like 1 (KOX 8) |
| ZNF16 | | NM_006958 | 1225 | ZnF-C2H2 | zinc finger protein 16 (KOX 9) |
| ZNF160 | | X78928 | 1226 | ZnF-C2H2 | zinc finger protein 160 |
| ZNF161 | | NM_007146 | 1227 | ZnF-C2H2 | zinc finger protein 161 |
| ZNF165 | | NM_003447 | 1228 | ZnF-C2H2 | zinc finger protein 165 |
| ZNF169 | | U28251 | 1229 | ZnF-C2H2 | zinc finger protein 169 |
| ZNF17 | | AB075827 | 1230 | ZnF-C2H2 | zinc finger protein 17 (HPF3, KOX 10) |
| ZNF174 | | NM_003450 | 1231 | ZnF-C2H2 | zinc finger protein 174 |
| ZNF175 | | NM_007147 | 1232 | ZnF-C2H2 | zinc finger protein 175 |
| ZNF177 | | NM_003451 | 1233 | ZnF-C2H2 | zinc finger protein 177 |
| ZNF179 | | NM_007148 | 1234 | ZnF-Other | zinc finger protein 179 |
| ZNF18 | | X52342 | 1235 | ZnF-C2H2 | zinc finger protein 18 (KOX 11) |
| ZNF180 | | NM_013256 | 1236 | ZnF-C2H2 | zinc finger protein 180 (HHZ168) |
| ZNF183 | | NM_006978 | 1237 | ZnF-Other | zinc finger protein 183 (RING finger, C3HC4 type) |
| ZNF183L1 | NT_009952:601 | NM_178861 | 1238 | ZnF-C3H | zinc finger protein 183-like 1 |
| ZNF184 | | U66561 | 1239 | ZnF-C2H2 | zinc finger protein 184 (Kruppel-like) |
| ZNF185 | | NM_007150 | 1240 | Co-activator | zinc finger protein 185 (LIM domain) |
| ZNF187 | | Z11773 | 1241 | ZnF-C2H2 | zinc finger protein 187 |
| ZNF189 | | NM_003452 | 1242 | ZnF-C2H2 | zinc finger protein 189 |
| ZNF19 | | NM_006961 | 1243 | ZnF-C2H2 | zinc finger protein 19 (KOX 12) |
| ZNF192 | | NM_006298 | 1244 | ZnF-C2H2 | zinc finger protein 192 |
| ZNF193 | | NM_006299 | 1245 | ZnF-C2H2 | zinc finger protein 193 |
| ZNF195 | | NM_007152 | 1246 | ZnF-C2H2 | zinc finger protein 195 |
| ZNF197 | | NM_006991 | 1247 | ZnF-C2H2 | zinc finger protein 197 |
| ZNF2 | | Z60152 | 1248 | ZnF-C2H2 | zinc finger protein 2 (A1-5) |
| ZNF20 | | AL080125 | 1249 | ZnF-C2H2 | zinc finger protein 20 (KOX 13) |
| ZNF200 | | NM_003454 | 1250 | ZnF-C2H2 | zinc finger protein 200 |
| ZNF202 | | NM_003455 | 1251 | ZnF-C2H2 | zinc finger protein 202 |
| ZNF205 | | NM_003456 | 1252 | ZnF-C2H2 | zinc finger protein 205 |
| ZNF207 | | NM_003457 | 1253 | ZnF-C2H2 | zinc finger protein 207 |
| ZNF208 | | NM_007153 | 1254 | ZnF-C2H2 | zinc finger protein 208 |
| ZNF21 | | X52345 | 1255 | ZnF-C2H2 | zinc finger protein 21 (KOX 14) |
| ZNF211 | | NM_006385 | 1256 | ZnF-C2H2 | zinc finger protein 211 |
| ZNF212 | | NM_012256 | 1257 | ZnF-C2H2 | zinc finger protein 212 |
| ZNF213 | | AF017433 | 1258 | ZnF-C2H2 | zinc finger protein 213 |
| ZNF214 | | NM_013249 | 1259 | ZnF-C2H2 | zinc finger protein 214 |
| ZNF215 | | NM_013250 | 1260 | ZnF-C2H2 | zinc finger protein 215 |
| ZNF216 | | NM_006007 | 1261 | ZnF-AN1 | zinc finger protein 216 |
| ZNF217 | | NM_006526 | 1262 | ZnF-C2H2 | zinc finger protein 217 |
| ZNF219 | | NM_016423 | 1263 | ZnF-C2H2 | zinc finger protein 219 |
| ZNF22 | | NM_006963 | 1264 | ZnF-C2H2 | zinc finger protein 22 (KOX 15) |
| ZNF220 | | NM_006766 | 1265 | ZnF-PHD | zinc finger protein 220 |
| ZNF221 | | NM_013359 | 1266 | ZnF-C2H2 | zinc finger protein 221 |
| ZNF222 | | NM_013360 | 1267 | ZnF-C2H2 | zinc finger protein 222 |
| ZNF223 | | NM_013361 | 1268 | ZnF-C2H2 | zinc finger protein 223 |
| ZNF224 | | NM_013398 | 1269 | ZnF-C2H2 | zinc finger protein 224 |
| ZNF225 | | NM_013362 | 1270 | ZnF-C2H2 | zinc finger protein 225 |
| ZNF226 | | NM_016444 | 1271 | ZnF-C2H2 | zinc finger protein 226 |
| ZNF228 | | NM_013380 | 1272 | ZnF-C2H2 | zinc finger protein 228 |
| ZNF229 | | AF192979 | 1273 | ZnF-C2H2 | zinc finger protein 229 |
| ZNF23 | | AL080123 | 1274 | ZnF-C2H2 | zinc finger protein 23 (KOX 16) |
| ZNF230 | | NM_006300 | 1275 | ZnF-C2H2 | zinc finger protein 230 |
| ZNF232 | | NM_014519 | 1276 | ZnF-C2H2 | zinc finger protein 232 |
| ZNF233 | NT_011109:135 | NM_181756 | 1277 | ZnF-C2H2 | zinc finger protein 233 |
| ZNF234 | | X78927 | 1278 | ZnF-C2H2 | zinc finger protein 234 |
| ZNF235 | | NM_004234 | 1279 | ZnF-C2H2 | zinc finger protein 235 |
| ZNF236 | | NM_007345 | 1280 | ZnF-C2H2 | zinc finger protein 236 |
| ZNF237 | | NM_014242 | 1281 | ZnF-Other | zinc finger protein 237 |

TABLE 1-continued

Exemplary Human Transcription Factors

| Gene Abbrev | ScriptSureID | mRNA ID | SEQ ID NO: | Class | Description |
|---|---|---|---|---|---|
| ZNF238 | | NM_006352 | 1282 | ZnF-C2H2 | zinc finger protein 238 |
| ZNF239 | | NM_005674 | 1283 | ZnF-C2H2 | zinc finger protein 239 |
| ZNF24 | | NM_006965 | 1284 | ZnF-C2H2 | zinc finger protein 24 (KOX 17) |
| ZNF25 | | X52350 | 1285 | ZnF-C2H2 | zinc finger protein 25 (KOX 19) |
| ZNF253 | NT_011295:613 | NM_021047 | 1286 | ZnF-C2H2 | zinc finger protein 253 |
| ZNF254 | | NM_004876 | 1287 | ZnF-C2H2 | zinc finger protein 254 |
| ZNF255 | | NM_005774 | 1288 | ZnF-C2H2 | zinc finger protein 255 |
| ZNF256 | | NM_005773 | 1289 | ZnF-C2H2 | zinc finger protein 256 |
| ZNF257 | NT_033317:9 | NM_033468 | 1290 | ZnF-C2H2 | zinc finger protein 257 |
| ZNF258 | | NM_007167 | 1291 | ZnF-Other | zinc finger protein 258 |
| ZNF259 | | NM_003904 | 1292 | ZnF-Other | zinc finger protein 259 |
| ZNF26 | | NM_019591 | 1293 | ZnF-C2H2 | zinc finger protein 26 (KOX 20) |
| ZNF261 | | NM_005096 | 1294 | ZnF-Other | zinc finger protein 261 |
| ZNF262 | | NM_005095 | 1295 | ZnF-Other | zinc finger protein 262 |
| ZNF263 | | NM_005741 | 1296 | ZnF-C2H2 | zinc finger protein 263 |
| ZNF264 | | NM_003417 | 1297 | ZnF-C2H2 | zinc finger protein 264 |
| ZNF265 | | NM_005455 | 1298 | ZnF-Other | zinc finger protein 265 |
| ZNF266 | | X78924 | 1299 | ZnF-C2H2 | zinc finger protein 266 |
| ZNF267 | | NM_003414 | 1300 | ZnF-C2H2 | zinc finger protein 267 |
| ZNF268 | | AF317549 | 1301 | ZnF-C2H2 | zinc finger protein 268 |
| ZNF271 | | NM_006629 | 1302 | ZnF-C2H2 | zinc finger protein 271 |
| ZNF272 | | X78931 | 1303 | ZnF-C2H2 | zinc finger protein 272 |
| ZNF273 | | X78932 | 1304 | ZnF-C2H2 | zinc finger protein 273 |
| ZNF274 | | NM_016324 | 1305 | ZnF-C2H2 | zinc finger protein 274 |
| ZNF275 | | NM_020636 | 1306 | ZnF-C2H2 | zinc finger protein 275 |
| ZNF277 | | NM_021994 | 1307 | ZnF-C2H2 | zinc finger protein (C2H2 type) 277 |
| ZNF278 | | NM_014323 | 1308 | ZnF-BTB/POZ | zinc finger protein 278 |
| ZNF281 | | NM_012482 | 1309 | ZnF-C2H2 | zinc finger protein 281 |
| ZNF282 | | D30612 | 1310 | ZnF-C2H2 | zinc finger protein 282 |
| ZNF286 | | NM_020652 | 1311 | ZnF-C2H2 | zinc finger protein 286 |
| ZNF287 | | NM_020653 | 1312 | ZnF-C2H2 | zinc finger protein 287 |
| ZNF288 | | NM_015642 | 1313 | ZnF-BTB/POZ | zinc finger protein 288 |
| ZNF29 | | X52357 | 1314 | ZnF-C2H2 | zinc finger protein 29 (KOX 26) |
| ZNF294 | | AB018257 | 1315 | ZnF-Other | zinc finger protein 294 |
| ZNF295 | | NM_020727 | 1316 | ZnF-BTB/POZ | zinc finger protein 295 |
| ZNF297 | | NM_005453 | 1317 | ZnF-BTB/POZ | zinc finger protein 297 |
| ZNF297B | | NM_014007 | 1318 | ZnF-BTB/POZ | zinc finger protein 297B |
| ZNF3 | | NM_017715 | 1319 | ZnF-C2H2 | zinc finger protein 3 (A8-51) |
| ZNF30 | | X52359 | 1320 | ZnF-C2H2 | zinc finger protein 30 (KOX 28) |
| ZNF300 | NT_006859:367 | NM_052860 | 1321 | ZnF-C2H2 | zinc finger protein 300 |
| ZNF302 | NT_011196:498 | NM_018443 | 1322 | ZnF-C2H2 | zinc finger protein 302 |
| ZNF304 | | NM_020657 | 1323 | ZnF-C2H2 | zinc finger protein 304 |
| ZNF305 | | NM_014724 | 1324 | ZnF-C2H2 | zinc finger protein 305 |
| ZNF306 | | NM_024493 | 1325 | ZnF-C2H2 | zinc finger protein 306 |
| ZNF31 | | NM_145238 | 1326 | ZnF-C2H2 | zinc finger protein 31 (KOX 29) |
| ZNF313 | | NM_018683 | 1327 | ZnF-Other | zinc finger protein 313 |
| ZNF317 | NT_011176:75 | NM_020933 | 1328 | ZnF-C2H2 | zinc finger protein 317 |
| ZNF319 | | AB037809 | 1329 | ZnF-C2H2 | zinc finger protein 319 |
| ZNF32 | | NM_006973 | 1330 | ZnF-C2H2 | zinc finger protein 32 (KOX 30) |
| ZNF322A | NT_007592:1565 | NM_024639 | 1331 | ZnF-PHD | zinc finger protein 322A |
| ZNF323 | NT_007592:1771 | NM_030899 | 1332 | ZnF-C2H2 | zinc finger protein 323 |
| ZNF325 | | NM_016265 | 1333 | ZnF-C2H2 | zinc finger protein 325 |
| ZNF333 | NT_025155:3 | NM_032433 | 1334 | ZnF-C2H2 | zinc finger protein 333 |
| ZNF334 | | NM_018102 | 1335 | ZnF-C2H2 | zinc finger protein 334 |
| ZNF335 | NT_011362:859 | NM_022095 | 1336 | ZnF-C2H2 | zinc finger protein 335 |
| ZNF336 | NT_011387:1856 | NM_022482 | 1337 | ZnF-C2H2 | zinc finger protein 336 |
| ZNF337 | | AL049942 | 1338 | ZnF-C2H2 | zinc finger protein 337 |
| ZNF339 | NT_011387:1400 | NM_021220 | 1339 | ZnF-C2H2 | zinc finger protein 339 |
| ZNF33A | | X68687 | 1340 | ZnF-C2H2 | zinc finger protein 33a (KOX 31) |

TABLE 1-continued

Exemplary Human Transcription Factors

| Gene Abbrev | ScriptSureID | mRNA ID | SEQ ID NO: | Class | Description |
|---|---|---|---|---|---|
| ZNF341 | NT_028392:330 | NM_032819 | 1341 | ZnF-C2H2 | zinc finger protein 341 |
| ZNF342 | NT_011109:256 | NM_145288 | 1342 | ZnF-C2H2 | zinc finger protein 342 |
| ZNF347 | NT_011109:1491 | NM_032584 | 1343 | ZnF-C2H2 | zinc finger protein 347 |
| ZNF35 | | NM_003420 | 1344 | ZnF-C2H2 | zinc finger protein 35 (clone HF.10) |
| ZNF350 | NT_011109:1276 | NM_021632 | 1345 | ZnF-C2H2 | zinc finger protein 350 |
| ZNF354A | | NM_005649 | 1346 | ZnF-C2H2 | zinc finger protein 354A |
| ZNF358 | | NM_018083 | 1347 | ZnF-C2H2 | zinc finger protein 358 |
| ZNF36 | | U09848 | 1348 | ZnF-C2H2 | zinc finger protein 36 (KOX 18) |
| ZNF361 | | NM_018555 | 1349 | ZnF-C2H2 | zinc finger protein 361 |
| ZNF364 | | AL079314 | 1350 | ZnF-Other | zinc finger protein 364 |
| ZNF366 | NT_006713:99 | NM_152625 | 1351 | ZnF-C2H2 | zinc finger protein 366 |
| ZNF37A | | X69115 | 1352 | ZnF-C2H2 | zinc finger protein 37a (KOX 21) |
| ZNF37A | NT_033896:447 | AJ492195 | 1353 | ZnF-C2H2 | zinc finger protein 37a (KOX21) |
| ZNF38 | | NM_032924 | 1354 | ZnF-C2H2 | zinc finger protein 38 |
| ZNF382 | NT_011192:90 | NM_032825 | 1355 | ZnF-C2H2 | zinc finger protein ZNF382 |
| ZNF384 | NT_009731:144 | NM_133476 | 1356 | ZnF-C2H2 | zinc finger protein 384 |
| ZNF394 | NT_007933:1972 | NM_032164 | 1357 | ZnF-C2H2 | zinc finger protein 394 |
| ZNF396 | NT_010934:143 | NM_145756 | 1358 | ZnF-C2H2 | zinc finger protein 396 |
| ZNF397 | NT_010934:119 | NM_032347 | 1359 | ZnF-C2H2 | zinc finger protein 397 |
| ZNF398 | NT_007914:756 | NM_020781 | 1360 | ZnF-C2H2 | zinc finger protein 398 |
| ZNF406 | NT_007994:1 | AB040918 | 1361 | ZnF-C2H2 | zinc finger protein 406 |
| ZNF407 | NT_025004:1 | NM_017757 | 1362 | ZnF-C2H2 | zinc finger protein 407 |
| ZNF408 | | NM_024741 | 1363 | ZnF-C2H2 | zinc finger protein 408 |
| ZNF409 | NT_025892:468 | AB028979 | 1364 | ZnF-C2H2 | zinc finger protein 409 |
| ZNF41 | | M92443 | 1365 | ZnF-C2H2 | zinc finger protein 41 |
| ZNF42 | | NM_003422 | 1366 | ZnF-C2H2 | zinc finger protein 42 (myeloid-specific retinoic acid-responsive) |
| ZNF426 | NT_011176:123 | NM_024106 | 1367 | ZnF-C2H2 | zinc finger protein 426 |
| ZNF43 | | NM_003423 | 1368 | ZnF-C2H2 | zinc finger protein 43 (HTF6) |
| ZNF431 | NT_035560:82 | NM_133473 | 1369 | ZnF-C2H2 | zinc finger protein 431 |
| ZNF433 | NT_011176:487 | NM_152602 | 1370 | ZnF-C2H2 | zinc finger protein 433 |
| ZNF434 | NT_010552:596 | NM_017810 | 1371 | ZnF-C2H2 | zinc finger protein 434 |
| ZNF435 | NT_007592:1726 | NM_025231 | 1372 | ZnF-C2H2 | zinc finger protein 435 |
| ZNF436 | NT_032979:37 | NM_030634 | 1373 | ZnF-C2H2 | zinc finger protein 436 |
| ZNF44 | | X16281 | 1374 | ZnF-C2H2 | zinc finger protein 44 (KOX 7) |
| ZNF440 | NT_011176:446 | NM_152357 | 1375 | ZnF-AN1 | zinc finger protein 440 |
| ZNF443 | | NM_005815 | 1376 | ZnF-C2H2 | zinc finger protein 443 |
| ZNF445 | NT_034534:46 | NM_181489 | 1377 | ZnF-C2H2 | zinc finger protein 445 |
| ZNF45 | | NM_003425 | 1378 | ZnF-C2H2 | zinc finger protein 45 (a Kruppel-associated box (KRAB) domain polypeptide) |
| ZNF454 | NT_006802:20 | NM_182594 | 1379 | ZnF-C2H2 | zinc finger protein 454 |
| ZNF46 | | NM_006977 | 1380 | ZnF-BTB/POZ | zinc finger protein 46 (KUP) |
| ZNF481 | NT_017568:1387 | NM_020924 | 1381 | ZnF-BTB/POZ | zinc finger protein 481 |
| ZNF486 | NT_035560:14 | BC008936 | 1382 | ZnF-C2H2 | zinc finger protein 486 |
| ZNF490 | NT_011176:576 | NM_020714 | 1383 | ZnF-C2H2 | zinc finger protein 490 |
| ZNF491 | NT_011176:438 | NM_152356 | 1384 | ZnF-C2H2 | zinc finger protein 491 |
| ZNF493 | NT_035560:126b | NM_175910 | 1385 | ZnF-C2H2 | zinc finger protein 493 |
| ZNF494 | NT_011104:214 | NM_152677 | 1386 | ZnF-C2H2 | zinc finger protein 494 |
| ZNF495 | NT_011104:32a | NM_024303 | 1387 | ZnF-C2H2 | zinc finger protein 495 |
| ZNF496 | NT_031730:64 | NM_032752 | 1388 | ZnF-C2H2 | zinc finger protein 496 |
| ZNF497 | NT_011104:359 | NM_198458 | 1389 | ZnF-C2H2 | zinc finger protein 497 |
| ZNF498 | NT_007933:1998 | NM_145115 | 1390 | ZnF-C2H2 | zinc finger protein 498 |
| ZNF502 | NT_034534:1 | NM_033210 | 1391 | ZnF-C2H2 | zinc finger protein 502 |
| ZNF503 | NT_033890:224 | NM_032772 | 1392 | ZnF-C2H2 | zinc finger protein 503 |
| ZNF509 | NT_006051:22 | NM_145291 | 1393 | ZnF-BTB/POZ | zinc finger protein 509 |
| ZNF513 | NT_005204:559 | NM_144631 | 1394 | ZnF-C2H2 | zinc finger protein 513 |
| ZNF514 | NT_022300:33 | NM_032788 | 1395 | ZnF-C2H2 | zinc finger protein 514 |
| ZNF519 | NT_010859:601 | NM_145287 | 1396 | ZnF-C2H2 | zinc finger protein 519 |
| ZNF528 | NT_011109:1343 | NM_032423 | 1397 | ZnF-C2H2 | zinc finger protein 528 |
| ZNF6 | | NM_021998 | 1398 | ZnF-C2H2 | zinc finger protein 6 (CMPX1) |

TABLE 1-continued

Exemplary Human Transcription Factors

| Gene Abbrev | ScriptSureID | mRNA ID | SEQ ID NO: | Class | Description |
|---|---|---|---|---|---|
| ZNF7 | | NM_003416 | 1399 | ZnF-C2H2 | zinc finger protein 7 (KOX 4, clone HF.16) |
| ZNF71 | NT_011104:94 | NM_021216 | 1400 | ZnF-C2H2 | zinc finger protein 71 (Cos26) |
| ZNF73 | | NM_012480 | 1401 | ZnF-C2H2 | zinc finger protein 73 (Cos12) |
| ZNF74 | | NM_003426 | 1402 | ZnF-C2H2 | zinc finger protein 74 (Cos52) |
| ZNF75 | NT_011786:383 | NM_007131 | 1403 | ZnF-C2H2 | zinc finger protein 75 (D8C6) |
| ZNF75A | | NM_153028 | 1404 | ZnF-C2H2 | zinc finger protein 75a |
| ZNF76 | | NM_003427 | 1405 | ZnF-C2H2 | zinc finger protein 76 (expressed in testis) |
| ZNF77 | NT_011255:4 | NM_021217 | 1406 | ZnF-C2H2 | zinc finger protein 77 (pT1) |
| ZNF79 | | NM_007135 | 1407 | ZnF-C2H2 | zinc finger protein 79 (pT7) |
| ZNF8 | | M29581 | 1408 | ZnF-C2H2 | zinc-finger protein 8 (clone HF.18) |
| ZNF80 | | NM_007136 | 1409 | ZnF-C2H2 | zinc finger protein 80 (pT17) |
| ZNF81 | | X68011 | 1410 | ZnF-C2H2 | zinc finger protein 81 (HFZ20) |
| ZNF83 | | NM_018300 | 1411 | ZnF-C2H2 | zinc finger protein 83 (HPF1) |
| ZNF84 | | NM_003428 | 1412 | ZnF-C2H2 | zinc finger protein 84 (HPF2) |
| ZNF85 | | NM_003429 | 1413 | ZnF-C2H2 | zinc finger protein 85 (HPF4, HTF1) |
| ZNF9 | | NM_003418 | 1414 | ZnF-Other | zinc finger protein 9 (a cellular retroviral nucleic acid binding protein) |
| ZNF90 | | M61870 | 1415 | ZnF-C2H2 | zinc finger protein 90 (HTF9) |
| ZNF91 | | NM_003430 | 1416 | ZnF-C2H2 | zinc finger protein 91 (HPF7, HTF10) |
| ZNF92 | | M61872 | 1417 | ZnF-C2H2 | zinc finger protein 92 (HTF12) |
| ZNF93 | | M61873 | 1418 | ZnF-C2H2 | zinc finger protein 93 (HTF34) |
| ZNF-kaiso | | NM_006777 | 1419 | ZnF-BTB/POZ | Kaiso |
| ZNFN1A1 | | NM_006060 | 1420 | ZnF-C2H2 | zinc finger protein, subfamily 1A, 1 (Ikaros) |
| ZNFN1A2 | | NM_016260 | 1421 | ZnF-C2H2 | zinc finger protein, subfamily 1A, 2 (Helios) |
| ZNFN1A3 | | NM_012481 | 1422 | ZnF-C2H2 | zinc finger protein, subfamily 1A, 3 (Aiolos) |
| ZNFN1A4 | NT_009458:35 | NM_022465 | 1423 | ZnF-MYND | zinc finger protein, subfamily 1A, 4 (Eos) |
| ZNF-U69274 | | NM_014415 | 1424 | ZnF-BTB/POZ | zinc finger protein |
| ZNRF1 | NT_035368:168 | NM_032268 | 1425 | ZnF-Other | zinc and ring finger protein 1 |
| ZXDA | | L14787 | 1426 | ZnF-C2H2 | zinc finger, X-linked, duplicated A |
| ZXDB | | L14788 | 1427 | ZnF-C2H2 | zinc finger, X-linked, duplicated B |
| ZYX | NT_007914:428 | NM_003461 | 1428 | Co-activator | zyxin |

SOX2

(SEQ ID NO: 1501; NM_003106)

```
  1 ggatggttgt ctattaactt gttcaaaaaa gtatcaggag ttgtcaaggc agagaagaga
 61 gtgtttgcaa aagggggaaa gtagtttgct gcctctttaa gactaggact gagagaaaga
121 agaggagaga gaaagaaagg gagagaagtt tgagccccag gcttaagcct ttccaaaaaa
181 taataataac aatcatcggc ggcggcagga tcggccagag gaggagggaa gcgcttttttt
```

-continued

```
 241 tgatcctgat tccagtttgc ctctctcttt ttttccccca aattattctt cgcctgattt
 301 tcctcgcgga gccctgcgct cccgacaccc ccgcccgcct cccctcctcc tctcccccg
 361 cccgcgggcc ccccaaagtc ccggccgggc cgagggtcgg cggccgccgg cgggccgggc
 421 ccgcgcacag cgcccgcatg tacaacatga tggagacgga gctgaagccg ccgggccccgc
 481 agcaaacttc ggggggcggc ggcggcaact ccaccgcggc ggcggccggc ggcaaccaga
 541 aaaacagccc ggaccgcgtc aagcggccca tgaatgcctt catggtgtgg cccgcgggc
 601 agcggcgcaa gatggcccag gagaacccca agatgcacaa ctcggagatc agcaagcgcc
 661 tgggcgccga gtggaaactt ttgtcggaga cggagaagcg gccgttcatc gacgaggcta
 721 agcggctgcg agcgctgcac atgaaggagc acccggatta taaataccgg ccccggcgga
 781 aaaccaagac gctcatgaag aaggataagt acacgctgcc cggcgggctg ctggcccccg
 841 gcggcaatag catggcgagc ggggtcgggg tgggcgccgg cctgggcgcg ggcgtgaacc
 901 agcgcatgga cagttacgcg cacatgaacg gctggagcaa cggcagctac agcatgatgc
 961 aggaccagct gggctacccg cagcacccgg gcctcaatgc gcacggcgca gcgcagatgc
1021 agcccatgca ccgctacgac gtgagcgccc tgcagtacaa ctccatgacc agctcgcaga
1081 cctacatgaa cggctcgccc acctacagca tgtcctactc gcagcagggc acccctggca
1141 tggctcttgg ctccatgggt tcggtggtca agtccgaggc cagctccagc cccctgtgg
1201 ttacctcttc ctcccactcc agggcgccct gccaggccgg ggacctccgg gacatgatca
1261 gcatgtatct ccccggcgcc gaggtgccgg aacccgccgc ccccagcaga cttcacatgt
1321 cccagcacta ccagagcggc ccggtgcccg gcacggccat taacggcaca ctgcccctct
1381 cacacatgtg agggccggac agcgaactgg aggggggaga aattttcaaa gaaaaacgag
1441 ggaaatggga ggggtgcaaa agaggagagt aagaaacagc atggagaaaa cccggtacgc
1501 tcaaaaagaa aaaggaaaaa aaaaaatccc atcacccaca gcaaatgaca gctgcaaaag
1561 agaacaccaa tcccatccac actcacgcaa aaaccgcgat gccgacaaga aaacttttat
1621 gagagagatc ctggacttct ttttggggga ctattttgt acagagaaaa cctggggagg
1681 gtggggaggg cggggaatg gaccttgtat agatctggag gaaagaaagc tacgaaaaac
1741 tttttaaaag ttctagtggt acggtaggag ctttgcagga agtttgcaaa agtctttacc
1801 aataatattt agagctagtc tccaagcgac gaaaaaaatg ttttaatatt tgcaagcaac
1861 ttttgtacag tatttatcga gataaacatg gcaatcaaaa tgtccattgt ttataagctg
1921 agaatttgcc aatatttttc aaggagaggc ttcttgctga attttgattc tgcagctgaa
1981 atttaggaca gttgcaaacg tgaaagaag aaaattattc aaatttggac attttaattg
2041 tttaaaaatt gtacaaaagg aaaaaattag aataagtact ggcgaaccat ctctgtggtc
2101 ttgtttaaaa agggcaaaag ttttagactg tactaaattt tataacttac tgttaaaagc
2161 aaaaatggcc atgcaggttg acaccgttgg taatttataa tagcttttgt tcgatcccaa
2221 ctttccattt tgttcagata aaaaaaacca tgaaattact gtgtttgaaa tattttctta
2281 tggtttgtaa tatttctgta aatttattgt gatatttaa ggttttcccc cctttatttt
2341 ccgtagttgt attttaaaag attcggctct gtattatttg aatcagtctg ccgagaatcc
2401 atgtatatat ttgaactaat atcatcctta taacaggtac attttcaact taagttttta
2461 ctccattatg cacagtttga gataaataaa tttttgaaat atggacactg aaaaaaaaaa
```

FoxP3

The FOXP3 (forkhead box P3) gene encodes for a protein involved in immune system responses. A member of the FOX protein family, FOXP3 is a transcription factor that plays a role in the development and function of regulatory T cells. The induction or administration of Foxp3 positive T cells in animal studies indicate marked reductions in (autoimmune) disease severity in models of diabetes, multiple sclerosis, asthma, inflammatory bowel disease, thyroiditis and renal disease.

The FoxP3 protein can be expressed in a cell using the synthetic, modified RNAs described herein.

Targeting Moiety

As used herein, the term "targeting moiety" refers to an agent that directs a composition to a particular tissue, cell type, receptor, or other area of interest. As per this definition, a targeting moiety can be attached directly to a synthetic, modified RNA or indirectly to a composition used for delivering a synthetic, modified RNA (e.g., a liposome, polymer etc) to direct expression in a particular cell etc. A targeting moiety can also be encoded or expressed by a synthetic, modified-NA as described herein, such that a cell expresses a targeting moiety on it surface, permitting a cell to be targeted to a desired tissue, organ etc. For the avoidance of confusion, targeting moieties expressed on a cell surface are referred to herein as "homing moieties."

Non-limiting examples of a targeting moiety or homing moiety include, but are not limited to, an oligonucleotide, an antigen, an antibody or functional fragment thereof, a ligand, a cell-surface receptor, a membrane-bound molecule, one member of a specific binding pair, a polyamide including a peptide having affinity for a biological receptor, an oligosaccharide, a polysaccharide, a steroid or steroid derivative, a hormone, e.g., estradiol or histamine, a hormone-mimic, e.g., morphine, or hormone-receptor, or other compound having binding specificity for a target. In the methods of the present invention, a targeting moiety promotes transport or preferential localization of a synthetic, modified RNA to a target cell, while a homing moiety permits the targeting of a cell modified using the synthetic, modified RNAs described herein to a particular tissue in vivo. It is contemplated herein that the homing moiety can be also encoded in a cell by a synthetic, modified RNA as described herein.

A synthetic, modified RNA or composition thereof can be targeted by means of a targeting moiety, including, e.g., an antibody or targeted liposome technology. In some embodiments, a synthetic, modified RNA or composition thereof is targeted to a specific tissue by using bispecific antibodies, for example produced by chemical linkage of an anti-ligand antibody (Ab) and an Ab directed toward a specific target. To avoid the limitations of chemical conjugates, molecular conjugates of antibodies can be used for production of recombinant, bispecific single-chain Abs directing ligands and/or chimeric inhibitors at cell surface molecules. The addition of an antibody to a synthetic, modified RNA composition permits the agent attached to accumulate additively at the desired target site. Antibody-based or non-antibody-based targeting moieties can be employed to deliver a ligand or the inhibitor to a target site. Preferably, a natural binding agent for an unregulated or disease associated antigen is used for this purpose.

Table 2 and Table 3 provide non-limiting examples of CD ("cluster of differentiation") molecules and other cell-surface/membrane bound molecules and receptors, such as transmembrane tyrosine kinase receptors, ABC transporters, and integrins, that can be expressed using the synthetic, modified RNA compositions and methods described herein for targeting and homing to cells of interest, or for changing the phenotype of a cell.

TABLE 2

List of CD Molecules

| Molecule (CD Number) | NCBI Name | NCBI Other Names |
|---|---|---|
| CD10 | MME | CALLA; CD10; NEP |
| CD100 | SEMA4D | CD100; M-sema G; M-sema-G; SEMAJ; coll-4 |
| CD101 | IGSF2 | CD101; V7 |
| CD102 | ICAM2 | CD102 |
| CD103 | ITGAE | CD103; HUMINAE |
| CD104 | ITGB4 | |
| CD105 | ENG | CD105; END; HHT1; ORW; ORW1 |
| CD106 | VCAM1 | INCAM-100 |
| CD107a | LAMP1 | CD107a; LAMPA; LGP120 |
| CD107b | LAMP2 | CD107b; LAMPB |
| CD107b | LAMP2 | CD107b; LAMPB |
| CD108 | SEMA7A | CD108; CDw108; H-SEMA-K1; H-Sema K1; H-Sema-L; SEMAK1; SEMAL |
| CD109 | CD109 | DKFZp762L1111; FLJ38569 |
| CD110 | MPL | C-MPL; CD110; MPLV; TPOR |
| CD111 | PVRL1 | CD111; CLPED1; ED4; HIgR; HVEC; PRR; PRR1; PVRR; PVRR1; SK-12 |
| CD112 | PVRL2 | CD112; HVEB; PRR2; PVRR2 |
| CD113 | PVRL3 | PVTL3; PPR3; PRR3; PVRR3; nectin-3; DKFZP566B0846 |
| CD114 | CSF3R | CD114; GCSFR |
| CD115 | CSF1R | C-FMS; CD115; CSFR; FIM2; FMS |
| CD116 | CSF2RA | CD116; CDw116; CSF2R; CSF2RAX; CSF2RAY; CSF2RX; CSF2RY; GM-CSF-R-alpha; GMCSFR; GMR; MGC3848; MGC4838 |
| CD117 | KIT | CD117; PBT; SCFR |
| CD118 | LIFR | LIFR; SWS; SJS2; STWS |
| CD119 | IFNGR1 | CD119; IFNGR |
| CD11a | ITGAL | CD11A; LFA-1; LFA1A |
| CD11a | ITGAL | CD11A; LFA-1; LFA1A |
| CD11a | ITGAL | CD11A; LFA-1; LFA1A |
| CD11b | ITGAM | CD11B; CR3A; MAC-1; MAC1A; MO1A |
| CD11c | ITGAX | CD11C |
| CD11d | ITGAD | ADB2; CD11D |
| CD120a | TNFRSF1A | CD120a; FPF; MGC19588; TBP1; TNF-R; TNF-R-I; TNF-R55; TNFAR; TNFR1; TNFR55; TNFR60; p55; p55-R; p60 |
| CD120b | TNFRSF1B | CD120b; TBPII; TNF-R-II; TNF-R75; TNFBR; TNFR2; TNFR80; p75; p75TNFR |

TABLE 2-continued

List of CD Molecules

| Molecule (CD Number) | NCBI Name | NCBI Other Names |
|---|---|---|
| CD121a | IL1R1 | CD121A; D2S1473; IL-1R-alpha; IL1R; IL1RA; P80 |
| CD121b | IL1R2 | IL1RB; MGC47725 |
| CD122 | IL2RB | P70-75 |
| CD123 | IL3RA | CD123; IL3R; IL3RAY; IL3RX; IL3RY; MGC34174; hIL-3Ra |
| CD124 | IL4R | CD124; IL4RA |
| CD125 | IL5RA | CDw125; HSIL5R3; IL5R; MGC26560 |
| CD126 | IL6R | CD126; IL-6R-1; IL-6R-alpha; IL6RA |
| CD127 | IL7R | CD127; CDW127; IL-7R-alpha |
| CD128a | see CD181 | see CD181 |
| CD128b | see CD182 | see CD182 |
| CD129 | IL9R | |
| CD13 | ANPEP | CD13; LAP1; PEPN; gp150 |
| CD130 | IL6ST | CD130; CDw130; GP130; GP130-RAPS; IL6R-beta |
| CD131 | CSF2RB | CD131; CDw131; IL3RB; IL5RB |
| CD132 | IL2RG | CD132; IMD4; SCIDX; SCIDX1 |
| CD133 | PROM1 | AC133; CD133; PROML1 |
| CD134 | TNFRSF4 | ACT35; CD134; OX40; TXGP1L |
| CD135 | FLT3 | CD135; FLK2; STK1 |
| CD136 | MST1R | CDw136; RON |
| CD137 | TNFRSF9 | 4-1BB; CD137; CDw137; ILA; MGC2172 |
| CD138 | SDC1 | CD138; SDC; SYND1 |
| CD139 | CD139 | |
| CD14 | CD14 | |
| CD14 | CD14 | |
| CD140a | PDGFRA | CD140A; PDGFR2 |
| CD140b | PDGFRB | CD140B; JTK12; PDGF-R-beta; PDGFR; PDGFR1 |
| CD141 | THBD | CD141; THRM; TM |
| CD142 | F3 | CD142; TF; TFA |
| CD143 | ACE | ACE1; CD143; DCP; DCP1; MGC26566 |
| CD144 | CDH5 | 7B4 |
| CD146 | MCAM | CD146; MUC18 |
| CD147 | BSG | 5F7; CD147; EMMPRIN; M6; OK; TCSF |
| CD148 | PTPRJ | CD148; DEP1; HPTPeta; R-PTP-ETA; SCC1 |
| CD149 | see CD47R | see CD47R |
| CD15 | FUT4 | CD15; ELFT; FCT3A; FUC-TIV |
| CD15 | FUT4 | CD15; ELFT; FCT3A; FUC-TIV |
| CD15 | FUT4 | CD15; ELFT; FCT3A; FUC-TIV |
| CD150 | SLAMF1 | CD150; CDw150; SLAM |
| CD151 | CD151 | GP27; PETA-3; SFA1 |
| CD152 | CTLA4 | CD152 |
| CD153 | TNFSF8 | CD153; CD30L; CD30LG |
| CD154 | CD40LG | CD154; CD40L; CD40LG; HIGM1; IGM; IMD3; T-BAM; TRAP; gp39; hCD40L |
| CD155 | PVR | CD155; HVED; NECL5; PVS; TAGE4 |
| CD156a | ADAM8 | CD156; MS2 |
| CD156b | ADAM17 | CD156b; TACE; cSVP |
| CD156C | ADAM10 | kuz; MADM; CD156c; HsT18717 |
| CD157 | BST1 | CD157 |
| CD158A | KIR2DL1 | 47.11; CD158A; CL-42; NKAT1; p58.1 |
| CD158B1 | KIR2DL2 | CD158B1; CL-43; NKAT6; p58.2 |
| CD158B2 | KIR2DL3 | CD158B2; CD158b; CL-6; KIR-023GB; NKAT2; NKAT2A; NKAT2B; p58 |
| CD158C | KIR3DP1; KIR2DS6; KIRX | LOC392419 |
| CD158D | KIR2DL4 | 103AS; 15.212; CD158D; KIR103; KIR103AS |
| CD158E1 | KIR3DL1 | AMB11; CD158E1; CD158E1/2; CD158E2; CL-11; CL-2; KIR; KIR3DS1; NKAT10; NKAT3; NKB1; NKB1B |
| CD158E2 | KIR3DS1 | AMB11; CD158E1; CD158E1/2; CD158E2; CL-11; CL-2; KIR; KIR3DS1; NKAT10; NKAT3; NKB1; NKB1B |
| CD158F | KIR2DL5 | CD158F; KIR2DL5; KIR2DL5.1; KIR2DL5.3 |
| CD158G | KIR2DS5 | CD158G; NKAT9 |
| CD158H | KIR2DS1 | CD158H; EB6ActI; EB6ActII; p50.1 |
| CD158I | KIR2DS4 | CD158I; KIR1D; KKA3; NKAT8; PAX; cl-39 |
| CD158J | KIR2DS2 | 183ACTI; CD158J; CL-49; NKAT5; p50.2 |
| CD158K | KIR3DL2 | CD158K; CL-5; NKAT4; NKAT4A; NKAT4B |
| CD159a | KLRC1 | CD159A; MGC13374; MGC59791; NKG2; NKG2A |
| CD159c | KLRC2 | |
| CD160 | CD160 | BY55; NK1; NK28 |
| CD161 | KLRB1 | CD161; NKR; NKR-P1; NKR-P1A; NKRP1A; hNKR-P1A |
| CD162 | SELPLG | CD162; PSGL-1; PSGL1 |
| CD163 | CD163 | M130; MM130 |
| CD164 | CD164 | MGC-24; MUC-24; endolyn |
| CD165 | CD165 | |
| CD166 | ALCAM | CD166; MEMD |
| CD167a | DDR1 | CAK; CD167; DDR; EDDR1; MCK10; NEP; NTRK4; PTK3; PTK3A; RTK6; TRKE |

TABLE 2-continued

List of CD Molecules

| Molecule (CD Number) | NCBI Name | NCBI Other Names |
| --- | --- | --- |
| CD167b | DDR2 | TKT; MIG20a; NTRKR3; TYRO10 |
| CD168 | HMMR | RHAMM |
| CD169 | SN | CD169; FLJ00051; FLJ00055; FLJ00073; FLJ32150; SIGLEC-1; dJ1009E24.1 |
| CD16a | FCGR3A | CD16; FCG3; FCGR3; IGFR3 |
| CD16b | FCGR3B | CD16; FCG3; FCGR3 |
| CD17 | carbohydrate | carbohydrate |
| CD170 | SIGLEC5 | CD33L2; OB-BP2; OBBP2; SIGLEC-5 |
| CD171 | L1CAM | CAML1; CD171; HSAS; HSAS1; MASA; MIC5; N-CAML1; S10; SPG1 |
| CD172a | PTPNS1 | BIT; MFR; MYD-1; P84; SHPS-1; SHPS1; SIRP; SIRP-ALPHA-1; SIRPalpha; SIRPalpha2 |
| CD172b | SIRPB1 | SIRP-BETA-1 |
| CD172g | SIRPB2 | SIRP-B2; bA77C3.1 |
| CD173 | carbohydrate | carbohydrate |
| CD174 | FUT3 | LE; Les |
| CD175 | carbohydrate | carbohydrate |
| CD175s | carbohydrate | carbohydrate |
| CD176 | carbohydrate | carbohydrate |
| CD177 | CD177 | CD177; HNA2A; NB1 |
| CD178 | FASLG | FASL; CD178; CD95L; TNFSF6; APT1LG1 |
| CD179a | VPREB1 | IGI; IGVPB; VPREB |
| CD179b | IGLL1 | 14.1; CD179b; IGL1; IGL5; IGLL; IGO; IGVPB; VPREB2 |
| CD18 | ITGB2 | CD18; LAD; LCAMB; LFA-1; MF17; MFI7 |
| CD180 | CD180 | LY64; Ly78; RP105; MGC126233; MGC126234 |
| CD181 | IL8RA | C-C CKR-1; C-C-CKR-1; CD128; CDw128a; CMKAR1; CXCR1; IL8R1; IL8RBA |
| CD182 | IL8RB | CDw128b; CMKAR2; CXCR2; IL8R2; IL8RA |
| CD183 | CXCR3 | CD183; CKR-L2; CMKAR3; GPR9; IP10; IP10-R; Mig-R; MigR |
| CD184 | CXCR4 | D2S201E; HM89; HSY3RR; LAP3; LESTR; NPY3R; NPYR; NPYY3R; WHIM |
| CD185 | BLR1 | BLR1; CXCR5; MDR15 |
| CD186 | CXCR6 | CXCR6; BONZO; STRL33; TYMSTR |
| CD187 | | |
| CD188 | | |
| CD189 | | |
| CD19 | CD19 | B4; MGC12802 |
| CD190 | | |
| CD191 | CCR1 | CKR-1; CMKBR1; HM145; MIP1aR; SCYAR1 |
| CD192 | CCR2 | CC-CKR-2; CCR2A; CCR2B; CKR2; CKR2A; CKR2B; CMKBR2; MCP-1-R |
| CD193 | CCR3 | CC-CKR-3; CKR3; CMKBR3 |
| CD194 | CCR4 | CC-CKR-4; CKR4; CMKBR4; ChemR13; HGCN |
| CD195 | CCR5 | CC-CKR-5; CCCKR5; CD195; CKR-5; CKR5; CMKBR5 |
| CD196 | CCR6 | CCR6; BN-1; CKR6; DCR2; CKRL3; DRY-6; GPR29; CKR-L3; CMKBR6; GPRCY4; STRL22; GPR-CY4 |
| CD197 | CCR7 | BLR2; CDw197; CMKBR7; EBI1 |
| CD1a | CD1A | CD1 |
| CD1b | CD1B | CD1 |
| CD1c | CD1C | CD1 |
| CD1d | CD1D | |
| CD1d | CD1D | |
| CD1e | CD1E | HSCDIEL |
| CD2 | CD2 | SRBC; T11 |
| CD2 | CD2 | SRBC; T11 |
| CD20 | MS4A1 | B1; Bp35; CD20; LEU-16; MGC3969; MS4A2; S7 |
| CD200 | CD200 | MOX1; MOX2; MRC; OX-2 |
| CD201 | PROCR | CCCA; CCD41; EPCR; MGC23024; bA42O4.2 |
| CD202b | TEK | CD202B; TIE-2; TIE2; VMCM; VMCM1 |
| CD203c | ENPP3 | B10; CD203c; NPP3; PD-IBETA; PDNP3 |
| CD204 | MSR1 | SCARA1; SR-A; phSR1; phSR2 |
| CD205 | LY75 | CLEC13B; DEC-205; GP200-MR6 |
| CD206 | MRC1 | CLEC13D |
| CD207 | CD207 | LANGERIN |
| CD208 | LAMP3 | DC-LAMP; DCLAMP; LAMP; TSC403 |
| CD209 | CD209 | CDSIGN; DC-SIGN; DC-SIGN1 |
| CD21 | CR2 | C3DR; CD21 |
| CD211 | | |
| CD212 | IL12RB1 | IL-12R-BETA1; IL12RB; MGC34454 |
| CD213a1 | IL13RA1 | IL-13Ra; NR4 |
| CD213a2 | IL13RA2 | IL-13R; IL13BP |
| CD214 | | |
| CD215 | | |
| CD216 | | |
| CD217 | IL17R | IL-17RA; IL17RA; MGC10262; hIL-17R |
| CD218a | IL18R1 | IL18R1; IL1RRP; IL-1Rrp |
| CD218b | IL18RAP | IL18RAP; ACPL |
| CD219 | | |
| CD22 | CD22 | SIGLEC-2 |

TABLE 2-continued

List of CD Molecules

| Molecule (CD Number) | NCBI Name | NCBI Other Names |
|---|---|---|
| CD220 | INSR | |
| CD221 | IGF1R | JTK13 |
| CD222 | IGF2R | CD222; CIMPR; M6P-R; MPRI |
| CD223 | LAG3 | CD223 |
| CD224 | GGT1 | CD224; D22S672; D22S732; GGT; GTG |
| CD225 | IFITM1 | Sep-27; CD225; IFI17; LEU13 |
| CD226 | CD226 | DNAM-1; DNAM1; PTA1; TLiSA1 |
| CD227 | MUC1 | CD227; EMA; PEM; PUM |
| CD228 | MFI2 | MAP97; MGC4856; MTF1 |
| CD229 | LY9 | CD229; SLAMF3; hly9; mLY9 |
| CD23 | FCER2 | CD23; CD23A; FCE2; IGEBF |
| CD230 | PRNP | ASCR; CJD; GSS; MGC26679; PRIP; PrP; PrP27-30; PrP33-35C; PrPc |
| CD231 | TSPAN7 | A15; CCG-B7; CD231; DXS1692E; MXS1; TALLA-1; TM4SF2b |
| CD232 | PLXNC1 | PLXN-C1; VESPR |
| CD233 | SLC4A1 | AE1; BND3; CD233; DI; EMPB3; EPB3; RTA1A; WD; WD1 |
| CD234 | DARC | CCBP1; DARC; GPD |
| CD235a | GYPA | GPA; MN; MNS |
| CD235b | GYPB | GPB; MNS; SS |
| CD236 | GYPC | GE; GPC |
| CD237 | | |
| CD238 | KEL | |
| CD239 | LU | AU; BCAM; MSK19 |
| CD24 | CD24 | CD24A |
| CD240CE | RHCE | RH; RH30A; RHC; RHE; RHIXB; RHPI; Rh4; RhVI; RhVIII |
| CD240D | RHD | CD240D; DIIIc; RH; RH30; RHCED; RHDVA(TT); RHPII; RHXIII; Rh30a; Rh4; RhII; RhK562-II; RhPI |
| CD241 | RHAG | RH2; RH50A |
| CD242 | ICAM4 | LW |
| CD243 | ABCB1 | ABC20; CD243; CLCS; GP170; MDR1; P-gp; PGY1 |
| CD244 | CD244 | 2B4; NAIL; NKR2B4; Nmrk; SLAMF4 |
| CD245 | CD245 | |
| CD246 | ALK | |
| CD247 | CD247 | CD3-ZETA; CD3H; CD3Q; TCRZ |
| CD248 | CD248 | CD164L1 |
| CD249 | ENPEP | APA; gp160; EAP |
| CD25 | IL2RA | CD25; IL2R; TCGFR |
| CD25 | IL2RA | CD25; IL2R; TCGFR |
| CD25 | IL2RA | CD25; IL2R; TCGFR |
| CD25 | IL2RA | CD25; IL2R; TCGFR |
| CD25 | IL2RA | CD25; IL2R; TCGFR |
| CD250 | | |
| CD251 | | |
| CD252 | TNFSF4 | TNFSF4; GP34; OX4OL; TXGP1; CD134L; OX-40L; OX40L |
| CD253 | TNFSF10 | TNFSF10; TL2; APO2L; TRAIL; Apo-2L |
| CD254 | TNFSF11 | ODF; OPGL; sOdf; CD254; OPTB2; RANKL; TRANCE; hRANKL2 |
| CD255 | | |
| CD256 | TNFSF13 | APRIL; TALL2; TRDL-1; UNQ383/PRO715 |
| CD257 | TNFSF13B | BAFF; BLYS; TALL-1; TALL1; THANK; TNFSF20; ZTNF4; delta BAFF |
| CD258 | TNFSF14 | TNFSF14; LTg; TR2; HVEML; LIGHT |
| CD259 | | |
| CD26 | DPP4 | ADABP; ADCP2; CD26; DPPIV; TP103 |
| CD260 | | |
| CD261 | TNFRSF10A | APO2; DR4; MGC9365; TRAILR-1; TRAILR1 |
| CD262 | TNFRSF10B | DR5; KILLER; KILLER/DR5; TRAIL-R2; TRAILR2; TRICK2; TRICK2A; TRICK2B; TRICKB; ZTNFR9 |
| CD263 | TNFRSF10C | DCR1; LIT; TRAILR3; TRID |
| CD264 | TNFRSF10D | DCR2; TRAILR4; TRUNDD |
| CD265 | TNFRSF11A | EOF; FEO; ODFR; OFE; PDB2; RANK; TRANCER |
| CD266 | TNFRSF12A | TNFRSF12A; FN14; TWEAKR |
| CD267 | TNFRSF13B | CVID; TACI; CD267; FLJ39942; MGC39952; MGC133214; TNFRSF14B |
| CD268 | TNFRSF13C | BAFFR; CD268; BAFF-R; MGC138235 |
| CD269 | TNFRSF17 | BCM; BCMA |
| CD27 | TNFRSF7 | CD27; MGC20393; S152; T14; Tp55 |
| CD270 | | |
| CD271 | NGFR | NGFR; TNFRSF16; p75(NTR) |
| CD272 | BTLA | BTLA1; FLJ16065 |
| CD273 | PDCD1LG2 | PDCD1LG2; B7DC; Btdc; PDL2; PD-L2; PDCD1L2; bA574F11.2 |
| CD274 | CD274 | B7-H; B7H1; PD-L1; PDCD1L1; PDL1 |
| CD275 | ICOSLG | B7-H2; B7H2; B7RP-1; B7RP1; GL50; ICOS-L; ICOSLG; KIAA0653; LICOS |
| CD276 | CD276 | B7H3 |
| CD277 | BTN3A1 | BTF5; BT3.1 |
| CD278 | ICOS | AILIM; MGC39850 |
| CD279 | PDCD1 | PD1; SLEB2; hPD-1 |
| CD28 | CD28 | Tp44 |

TABLE 2-continued

List of CD Molecules

| Molecule (CD Number) | NCBI Name | NCBI Other Names |
|---|---|---|
| CD28 | CD28 | Tp44 |
| CD28 | CD28 | Tp44 |
| CD28 | CD28 | Tp44 |
| CD28 | CD28 | Tp44 |
| CD28 | CD28 | Tp44 |
| CD280 | MRC2 | MRC2; UPARAP; ENDO180; KIAA0709 |
| CD281 | TLR1 | TLR1; TIL; rsc786; KIAA0012; DKFZp547I0610; DKFZp564I0682 |
| CD282 | TLR2 | TIL4 |
| CD283 | TLR3 | TLR3 |
| CD284 | TLR4 | TOLL; hToll |
| CD285 | | |
| CD286 | TLR6 | CD286 |
| CD287 | | |
| CD288 | TLR8 | TLR8 |
| CD289 | TLR9 | none |
| CD29 | ITGB1 | CD29; FNRB; GPIIA; MDF2; MSK12; VLAB |
| CD290 | TLR10 | TLR10 |
| CD291 | | |
| CD292 | BMPR1A | BMPR1A; ALK3; ACVRLK3 |
| CD294 | GPR44 | CRTH2 |
| CD295 | LEPR | LEPR; OBR |
| CD296 | ART1 | ART2; RT6 |
| CD297 | ART4 | DO; DOK1; CD297; ART4 |
| CD298 | ATP1B3 | ATP1B3; ATPB-3; FLJ29027 |
| CD299 | CLEC4M | DC-SIGN2; DC-SIGNR; DCSIGNR; HP10347; LSIGN; MGC47866 |
| CD3 | see CD3D, CD3E, CD3G | see CD3D, CD3E, CD3G |
| CD3 | see CD3D, CD3E, CD3G | see CD3D, CD3E, CD3G |
| CD30 | TNFRSF8 | CD30; D1S166E; KI-1 |
| CD300a | CD300A | CMRF-35-H9; CMRF35H; CMRF35H9; IRC1; IRC2; IRp60 |
| CD300C | CD300C | CMRF-35A; CMRF35A; CMRF35A1; LIR |
| CD301 | CLEC10A | HML; HML2; CLECSF13; CLECSF14 |
| CD302 | CD302 | DCL-1; BIMLEC; KIAA0022 |
| CD303 | CLEC4C | BDCA2; CLECSF11; DLEC; HECL; PRO34150; CLECSF7 |
| CD304 | NRP1 | NRP; VEGF165R |
| CD305 | LAIR1 | LAIR-1 |
| CD306 | LAIR2 | LAIR2 |
| CD307 | FCRL5 | BXMAS1 |
| CD308 | | |
| CD309 | KDR | KDR; FLK1; VEGFR; VEGFR2 |
| CD31 | PECAM1 | CD31 |
| CD31 | PECAM1 | CD31 |
| CD31 | PECAM1 | CD31 |
| CD310 | | |
| CD311 | | |
| CD312 | EMR2 | |
| CD313 | | |
| CD314 | KLRK1 | KLRK1; KLR; NKG2D; NKG2-D; D12S2489E |
| CD315 | PTGFRN | PTGFRN; FPRP; EWI-F; CD9P-1; SMAP-6; FLJ11001; KIAA1436 |
| CD316 | IGSF8 | IGSF8; EWI2; PGRL; CD81P3 |
| CD317 | BST2 | none |
| CD318 | CDCP1 | CDCP1; FLJ22969; MGC31813 |
| CD319 | SLAMF7 | 19A; CRACC; CS1 |
| CD320 | CD320 | 8D6A; 8D6 |
| CD321 | F11R | JAM; KAT; JAM1; JCAM; JAM-1; PAM-1 |
| CD322 | JAM2 | C21orf43; VE-JAM; VEJAM |
| CD323 | | |
| CD324 | CDH1 | Arc-1; CDHE; ECAD; LCAM; UVO |
| CD325 | CDH2 | CDHN; NCAD |
| CD326 | TACSTD1 | CO17-1A; EGP; EGP40; Ep-CAM; GA733-2; KSA; M4S1; MIC18; MK-1; TROP1; hEGP-2 |
| CD327 | SIGLEC6 | CD33L; CD33L1; OBBP1; SIGLEC-6 |
| CD328 | SIGLEC7 | p75; QA79; AIRM1; CDw328; SIGLEC-7; p75/AIRM1 |
| CD329 | SIGLEC9 | CDw329; OBBP-LIKE |
| CD32a | FCGR2A | CD32; CDw32; FCG2; FCGR2; FCGR2A1; FcGR; IGFR2; MGC23887; MGC30032 |
| CD32b | FCGR2B | CD32; FCG2; FCGR2; IGFR2 |
| CD32c | FCGR2C | CD32; FcgammaRIIC |
| CD33 | CD33 | SIGLEC-3; p67 |
| CD33 | CD33 | SIGLEC-3; p67 |
| CD330 | | |
| CD331 | FGFR1 | FGFR1; H2; H3; H4; H5; CEK; FLG; FLT2; KAL2; BFGFR; C-FGR; N-SAM |
| CD332 | FGFR2 | FGFR2; BEK; JWS; CEK3; CFD1; ECT1; KGFR; TK14; TK25; BFR-1; K-SAM |
| CD333 | FGFR3 | FGFR3; ACH; CEK2; JTK4; HSFGFR3EX |

TABLE 2-continued

List of CD Molecules

| Molecule (CD Number) | NCBI Name | NCBI Other Names |
|---|---|---|
| CD334 | FGFR4 | FGFR4; TKF; JTK2; MGC20292 |
| CD335 | NCR1 | LY94; NK-p46; NKP46 |
| CD336 | NCR2 | LY95; NK-p44; NKP44 |
| CD337 | NCR3 | 1C7; LY117; NKp30 |
| CD338 | ABCG2 | MRX; MXR; ABCP; BCRP; BMDP; MXR1; ABC15; BCRP1; CDw338; EST157481; MGC102821 |
| CD339 | JAG1 | JAG1; AGS; AHD; AWS; HJ1; JAGL1 |
| CD34 | CD34 | |
| CD34 | CD34 | |
| CD340 | ERBB2 | NEU; NGL; HER2; TKR1; HER-2; c-erb B2; HER-2/neu |
| CD344 | FZD4 | EVR1; FEVR; Fz-4; FzE4; GPCR; FZD4S; MGC34390 |
| CD349 | FZD9 | FZD3 |
| CD35 | CR1 | C3BR; CD35 |
| CD350 | FZD10 | FzE7; FZ-10; hFz10 |
| CD36 | CD36 | FAT; GP3B; GP4; GPIV; PASIV; SCARB3 |
| CD37 | CD37 | GP52-40 |
| CD38 | CD38 | T10 |
| CD39 | ENTPD1 | ATPDase; CD39; NTPDase-1 |
| CD3d | CD3D | CD3-DELTA; T3D |
| CD3e | CD3E | CD3-EPSILON; T3E; TCRE |
| CD3g | CD3G | CD3-GAMMA; T3G |
| CD4 | CD4 | |
| CD4 | CD4 | |
| CD40 | CD40 | p50; Bp50; CDW40; MGC9013; TNFRSF5 |
| CD41 | ITGA2B | CD41; CD41B; GP2B; GPIIb; GTA |
| CD42a | GP9 | CD42a |
| CD42b | GP1BA | BSS; CD42B; CD42b-alpha; GP1B; MGC34595 |
| CD42c | GP1BB | CD42c |
| CD42d | GP5 | CD42d |
| CD43 | SPN | CD43; GPL115; LSN |
| CD43 | SPN | CD43; GPL115; LSN |
| CD43 | SPN | CD43; GPL115; LSN |
| CD43 | SPN | CD43; GPL115; LSN |
| CD44 | CD44 | CDW44; ECMR-III; IN; INLU; LHR; MC56; MDU2; MDU3; MGC10468; MIC4; MUTCH-I; Pgp1 |
| CD44 | CD44 | CDW44; ECMR-III; IN; INLU; LHR; MC56; MDU2; MDU3; MGC10468; MIC4; MUTCH-I; Pgp1 |
| CD44 | CD44 | CDW44; ECMR-III; IN; INLU; LHR; MC56; MDU2; MDU3; MGC10468; MIC4; MUTCH-I; Pgp1 |
| CD45 | PTPRC | B220; CD45; GP180; LCA; LY5; T200 |
| CD45RA | PTPRC | |
| CD45RB | PTPRC | |
| CD45RC | PTPRC | |
| CD45RO | PTPRC | |
| CD46 | MCP | CD46; MGC26544; MIC10; TLX; TRA2.10 |
| CD47 | CD47 | IAP; MER6; OA3 |
| CD48 | CD48 | BCM1; BLAST; BLAST1; MEM-102; SLAMF2; hCD48; mCD48 |
| CD49a | ITGA1 | CD49a; VLA1 |
| CD49b | ITGA2 | BR; CD49B; VLAA2 |
| CD49c | ITGA3 | CD49C; GAP-B3; GAPB3; MSK18; VCA-2; VL3A; VLA3a |
| CD49d | ITGA4 | CD49D |
| CD49e | ITGA5 | CD49e; FNRA; VLA5A |
| CD49f | ITGA6 | CD49f |
| CD5 | CD5 | LEU1; T1 |
| CD5 | CD5 | LEU1; T1 |
| CD50 | ICAM3 | CD50; CDW50; ICAM-R |
| CD51 | ITGAV | CD51; MSK8; VNRA |
| CD52 | CD52 | CD52 |
| CD53 | CD53 | MOX44 |
| CD54 | ICAM1 | BB2; CD54 |
| CD55 | DAF | CD55; CR; TC |
| CD56 | NCAM1 | CD56; MSK39; NCAM |
| CD57 | CD57 | HNK-1; LEU7; NK-1 |
| CD58 | CD58 | LFA3 |
| CD59 | CD59 | MGC2354; MIC11; MIN1; MIN2; MIN3; MSK21; PROTECTIN |
| CD6 | CD6 | TP120 |
| CD6 | CD6 | TP120 |
| CD60a | carbohydrate | carbohydrate |
| CD60b | carbohydrate | carbohydrate |
| CD60b | carbohydrate | carbohydrate |
| CD60c | carbohydrate | carbohydrate |
| CD61 | ITGB3 | CD61; GP3A; GPIIIa |
| CD62E | SELE | CD62E; ELAM; ELAM1; ESEL; LECAM2 |

TABLE 2-continued

List of CD Molecules

| Molecule (CD Number) | NCBI Name | NCBI Other Names |
|---|---|---|
| CD62L | SELL | CD62L; LAM-1; LAM1; LECAM1; LNHR; LSEL; LYAM1; Leu-8; Lyam-1; PLNHR; TQ1; hLHRc |
| CD62P | SELP | CD62; CD62P; GMP140; GRMP; PADGEM; PSEL |
| CD63 | CD63 | LAMP-3; ME491; MLA1; OMA81H |
| CD64a | FCGR1A | CD64; FCRI; IGFR1 |
| CD65 | carbohydrate | carbohydrate |
| CD65s | carbohydrate | carbohydrate |
| CD66a | CEACAM1 | BGP; BGP1; BGPI; CD66; CD66A |
| CD66b | CEACAM8 | CD66b; CD67; CGM6; NCA-95 |
| CD66c | CEACAM6 | CD66c; CEAL; NCA |
| CD66d | CEACAM3 | CD66D; CGM1 |
| CD66e | CEACAM5 | CD66e; CEA |
| CD66f | PSG1 | B1G1; CD66f; PBG1; PSBG1; PSGGA; SP1 |
| CD67 | see CD66f | see CD66f |
| CD68 | CD68 | SCARD1 |
| CD69 | CD69 | none |
| CD7 | CD7 | GP40; LEU-9; TP41; Tp40 |
| CD7 | CD7 | GP40; LEU-9; TP41; Tp40 |
| CD70 | TNFSF7 | CD27L; CD27LG; CD70 |
| CD71 | TFRC | CD71; TFR; TRFR |
| CD72 | CD72 | LYB2 |
| CD73 | NT5E | CD73; E5NT; NT5; NTE; eN; eNT |
| CD74 | CD74 | DHLAG; HLADG; Ia-GAMMA |
| CD75 | carbohydrate | carbohydrate |
| CD75s | carbohydrate | carbohydrate |
| CD76 | see CD75 and CD75s | see CD75 and CD75s |
| CD77 | carbohydrate | carbohydrate |
| CD78 | deleted | deleted |
| CD79a | CD79A | IGA; MB-1 |
| CD79b | CD79B | B29; IGB |
| CD80 | CD80 | CD28LG; CD28LG1; LAB7 |
| CD81 | CD81 | S5.7; TAPA1 |
| CD82 | CD82 | 4F9; C33; CD82; GR15; IA4; R2; SAR2; ST6 |
| CD83 | CD83 | BL11; HB15 |
| CD84 | CD84 | LY9B; SLAMF5; hCD84; mCD84 |
| CD85A | LILRB3 | CD85A; HL9; ILT5; LIR-3; LIR3 |
| CD85B | LILRB6 | LILRB6 |
| CD85C | LILRB5 | CD85C; LIR-8; LIR8 |
| CD85D | LILRB2 | CD85D; ILT4; LIR-2; LIR2; MIR-10; MIR10 |
| CD85E | LILRA3 | CD85E; HM31; HM43; ILT6; LIR-4; LIR4 |
| CD85F | LILRB7 | CD85F; ILT11; LILRB7 |
| CD85G | LILRA4 | ILT7; CD85g; MGC129597 |
| CD85H | LILRA2 | CD85H; ILT1; LIR-7; LIR7 |
| CD85I | LILRA1 | CD85I; LIR-6; LIR6 |
| CD85J | LILRB1 | CD85; CD85J; ILT2; LIR-1; LIR1; MIR-7; MIR7 |
| CD85K | LILRB4 | CD85K; HM18; ILT3; LIR-5; LIR5 |
| CD85L | LILRP1 | ILT9; CD85l; LILRA6P |
| CD85M | LILRP2 | CD85m; ILT10; LILRA5 |
| CD86 | CD86 | B7-2; B70; CD28LG2; LAB72; MGC34413 |
| CD87 | PLAUR | CD87; UPAR; URKR |
| CD88 | C5R1 | C5A; C5AR; CD88 |
| CD89 | FCAR | CD89 |
| CD8a | CD8A | CD8; Leu2; MAL; p32 |
| CD8a | CD8A | CD8; Leu2; MAL; p32 |
| CD8b | CD8B1 | CD8B; LYT3; Leu2; Ly3 |
| CD9 | CD9 | BA2; DRAP-27; MIC3; MRP-1; P24 |
| CD90 | THY1 | CD90 |
| CD91 | LRP1 | A2MR; APOER; APR; CD91; LRP |
| CD92 | SLC44A1 | CTL1; CDW92; CHTL1; RP11-287A8.1 |
| CD93 | CD93 | C1QR1; C1qRP; CDw93; MXRA4; C1qR(P); dJ737E23.1 |
| CD94 | KLRD1 | CD94 |
| CD95 | FAS | APT1; CD95; FAS1; APO-1; FASTM; ALPS1A; TNFRSF6 |
| CD96 | CD96 | MGC22596; TACTILE |
| CD97 | CD97 | TM7LN1 |
| CD98 | SLC3A2 | 4F2; 4F2HC; 4T2HC; CD98; MDU1; NACAE |
| CD99 | CD99 | MIC2; MIC2X; MIC2Y |
| CD99R | CD99 | |
| CDW12 | CDw12 | CDw12; p90-120 |
| CDw145 | CDw145 | not listed |
| CDw198 | CCR8 | CKR-L1; CKRL1; CMKBR8; CMKBRL2; CY6; GPR-CY6; TER1 |
| CDw199 | CCR9 | GPR-9-6; GPR28 |
| CDw210a | IL10RA | CDW210A; HIL-10R; IL-10R1; IL10R |

TABLE 2-continued

List of CD Molecules

| Molecule (CD Number) | NCBI Name | NCBI Other Names |
|---|---|---|
| CDw210b | IL10RB | CDW210B; CRF2-4; CRFB4; D21S58; D21S66; IL-10R2 |
| CDw293 | BMPR1B | BMPR1B; ALK6; ALK-6 |

TABLE 3

List of Membrane-Bound Receptors

| Membrane-bound Receptor Name | mRNA ID |
|---|---|
| 5-HT3 receptor subunit E splice variant HTR3Ea | DQ644022.1 |
| 5-HT3 serotonin receptor (long isoform) | AJ003078.1 |
| 5-HT3c1 serotonin receptor-like protein | AY349352.1 |
|  | AY349353.1 |
| 5-hydroxytryptamine (serotonin) receptor 3 family member D | BC101091.2 BC101090.2 |
|  | NM_001145143.1 |
|  | NM_182537.2 |
|  | AJ437318.1 |
|  | AY159812.2 GI:110431739 |
| 5-hydroxytryptamine (serotonin) receptor 3, family member C (HTR3C) | NM_130770.2 |
|  | BC131799.1 |
|  | AF459285.1 |
| 5-hydroxytryptamine (serotonin) receptor 3, family member E (HTR3E) | NM_182589.2 |
|  | BC101183.2 |
|  | BC101185.2 |
|  | BC101182.1 |
|  | AY159813.2 |
|  | EU165354.1 |
| 5-hydroxytryptamine (serotonin) receptor 3A (HTR3A) | BC004453.1 |
|  | BC002354.2 |
|  | BT007204.1 GI:30583246 |
|  | NM_001161772.2 |
|  | NM_213621.3 |
|  | NM_000869.5 |
|  | AF498984.1 |
| 5-hydroxytryptamine (serotonin) receptor 3B (HTR3B) | NM_006028.3 |
|  | AK314268.1 |
|  | AF169255.1 |
|  | AF080582.1 |
|  | AM293589.1 |
| ABA-A receptor, alpha 1 subunit | X14766.1 |
| ABC protein | AF146074.1 |
| ABC transporter 7 protein | AB005289.1 |
| ABC transporter MOAT-B (MOAT-B) | AF071202.1 |
| ABC transporter MOAT-C (MOAT-C) | AF104942.1 |
| ABC transporter MOAT-D (MOAT-D) | AF104943.1 |
| ABC transporter umat (ABCB6 gene) | AJ289233.2 |
| ABCB5 mRNA for ATP-binding cassette, sub-family B (MDR/TAP), member 5 | AB353947.1 |
| ABCC4 protein | AB208973.1 |
| acetylcholine receptor (epsilon subunit) | X66403.1 |
| acetylcholine receptor delta subunit | X55019.1 GI:297401 |
| adrenoleukodystrophy related protein (ALDR) | AJ000327.1 |
| ALD gene | Z21876.1 |
| alpha 7 neuronal nicotinic acetylcholine receptor | U40583.1 |
| alpha-1 strychnine binding subunit of inhibitory glycine receptor mRNA | X52009.1 |
| alpha-2 strychnine binding subunit of inhibitory glycine receptor mRNA | X52008.1 |
| alpha-3 neuronal nicotinic acetylcholine receptor subunit | M37981.1 |
| amino butyric acid (GABA rho2) gene | M86868.1 |
| amino butyric acid (GABAA) receptor beta-3 subunit | M82919.1 |
| amma-aminobutyric acid (GABA) receptor, rho 1 | BC130344.1 |
| Anaplastic lymphoma receptor tyrosine kinase (ALK) | NM_004304.4 |
| anthracycline resistance associated protein | X95715.1 |
| ATP binding cassette transporter | AF038950.1 |
| ATP-binding cassette (sub-family C, member 6) (ABCC6 gene) | AM774324.1 |
|  | AM711638.1 |
| ATP-binding cassette 7 iron transporter (ABC7) | AF133659.1 |
| ATP-binding cassette C5 | AB209103.1 |
| ATP-binding cassette half-transporter (PRP) | AF308472.1 |
| ATP-binding cassette protein (ABCB5) | AY230001.1 |
|  | AY196484.1 |
| ATP-binding cassette protein ABCB9 (ABCB9) | AF216494.1 |

TABLE 3-continued

List of Membrane-Bound Receptors

| Membrane-bound Receptor Name | mRNA ID |
|---|---|
| ATP-binding cassette protein C11 (ABCC11) | AF367202.1 |
| | AF411579.1 |
| | AY040219.1 |
| | NM_003742.2 |
| ATP-binding cassette protein C12 (ABCC12) | AF395909.1 |
| | AF411578.1 |
| | AF411577.1 |
| | AF395908.1 |
| | AY040220.1 |
| ATP-binding cassette protein C13 | AY063514.1 |
| | AF518320.1 |
| ATP-binding cassette protein M-ABC1 | AF047690.1 |
| ATP-binding cassette subfamily B member 5 (ABCB5) | AY785909.1 AY851365.1 |
| ATP-binding cassette transporter C4 (ABCC4) | AY207008.1 AF541977.1 |
| ATP-binding cassette transporter MRP8 | AF352582.1 |
| ATP-binding cassette, sub-family B (MDR/TAP), member 1 (ABCB1) | BC130424.1 |
| | NM_000927.4 |
| ATP-binding cassette, sub-family B (MDR/TAP), member 10 (ABCB10) | BC064930.1 |
| | NM_012089.2 |
| | NM_001198934.1 |
| ATP-binding cassette, sub-family B (MDR/TAP), member 4 (ABCB4) | BC042531.1 |
| | BC020618.2 |
| | NM_018849.2 NM_000443.3 |
| | NM_018850.2 |
| ATP-binding cassette, sub-family B (MDR/TAP), member 5 (ABCB5) | BC104894.1 |
| | BC104920.1 |
| | NM_001163941.1 NM_178559.5 |
| ATP-binding cassette, sub-family B (MDR/TAP), member 6 (ABCB6) | BC000559.2 |
| | NM_005689.2 |
| ATP-binding cassette, sub-family B (MDR/TAP), member 7 (ABCB7) | BC006323.2 |
| | BT009918.1 |
| | NM_004299.3 |
| ATP-binding cassette, sub-family B (MDR/TAP), member 8 (ABCB8) | BC151235.1 BC141836.1 |
| | BGI:146327013 |
| | NM_007188.3 |
| | AK222911.1 |
| ATP-binding cassette, sub-family B (MDR/TAP), member 9 (ABCB9) | BC017348.2 |
| | BC064384.1 |
| | NM_019624.3 NM_019625.3 |
| | NM_203444.2 |
| ATP-binding cassette, sub-family C (CFTR/MRP), member 1 (ABCC1) | NM_019898.2 |
| | NM_019899.2 |
| | NM_019862.2 |
| | NM_004996.3 |
| | NM_019900.2 |
| | AB209120.1 |
| ATP-binding cassette, sub-family C (CFTR/MRP), member 10 (ABCC10) | NM_033450.2 GI:25914748 |
| ATP-binding cassette, sub-family C (CFTR/MRP), member 11 (ABCC11) | NM_145186.2 |
| | NM_032583.3 |
| | NM_033151.3 |
| ATP-binding cassette, sub-family C (CFTR/MRP), member 12 (ABCC12) | NM_033226.2 |
| ATP-binding cassette, sub-family C (CFTR/MRP), member 2 (ABCC2) | BC136419.1 GI:187953242 |
| | NM_000392.3 |
| ATP-binding cassette, sub-family C (CFTR/MRP), member 3 (ABCC3) | BC046126.1 |
| | BC137347.1 BC137348.1 |
| | BC104952.1 |
| | BC050370.1 |
| | NM_001144070.1 NM_003786.3 |
| | AB208954.1 |
| ATP-binding cassette, sub-family C (CFTR/MRP), member 4 (ABCC4) | BC041560.1 |
| | NM_001105515.1 NM_005845.3 |
| ATP-binding cassette, sub-family C (CFTR/MRP), member 5 (ABCC5) | BC140771.1 |
| | NM_005688.2 |
| ATP-binding cassette, sub-family C (CFTR/MRP), member 6 (ABCC6) | BC131732.1 |
| | NM_001171.5 |
| ATP-binding cassette, sub-family C (CFTR/MRP), member 8 (ABCC8) | NM_000352.3 |
| ATP-binding cassette, sub-family C (CFTR/MRP), member 9 (ABCC9) | NM_020298.2 NM_020297.2 |
| | NM_005691.2 |
| ATP-binding cassette, sub-family D (ALD), member 1 (ABCD1) | BC025358.1 |
| | BC015541.1 |
| | NM_000033.3 |
| ATP-binding cassette, sub-family D (ALD), member 2 (ABCD2) | BC104901.1 |
| | BC104903.1 |

TABLE 3-continued

List of Membrane-Bound Receptors

| Membrane-bound Receptor Name | mRNA ID |
|---|---|
| | NM_005164.3 |
| | AK314254.1 |
| ATP-binding cassette, sub-family D (ALD), member 3 (ABCD3) | BC009712.2 |
| | BC068509.1 |
| | BT006644.1 |
| | NM_001122674.1 NM_002858.3 |
| ATP-binding cassette, sub-family D (ALD), member 4 (ABCD4) | BC012815.2 |
| | BT007412.1 |
| | NM_005050.3 |
| beta 4 nicotinic acetylcholine receptor subunit | U48861.1 |
| bile salt export pump (BSEP) | AF136523.1 |
| | AF091582.1 |
| B-lymphocyte CR2-receptor (for complement factor C3d and Epstein-Barr virus) | Y00649.1 |
| Butyrophilin-like 2 (MHC class II associated) (BTNL2) | NM_019602.1 |
| Cadherin 1, type 1, E-cadherin (epithelial) (CDH1) | NM_004360.3 |
| Cadherin 13, H-cadherin (heart) (CDH13) | NM_001257.3 |
| Cadherin 15, type 1, M-cadherin (myotubule) (CDH15) | NM_004933.2 |
| Cadherin 16, KSP-cadherin (CDH16) | NM_001204746.1 |
| | NM_001204745.1 |
| | NM_001204744.1 |
| | NM_004062.3 |
| Cadherin 17, LI cadherin (liver-intestine) (CDH17) | NM_001144663.1 NM_004063.3 |
| Cadherin 19, type 2 (CDH19) | NM_021153.2 |
| Cadherin 2, type 1, N-cadherin (neuronal) (CDH2) | NM_001792.3 |
| cadherin 20, type 2 (CDH20) | NM_031891.2 |
| Cadherin 3, type 1, P-cadherin (CDH3) | NM_001793.4 |
| Cadherin 4, type 1, R-cadherin (CDH4) | NM_001794.2 |
| Cadherin 5, type 2 (CDH5) | NM_001795.3 |
| Cadherin 6, type 2, K-cadherin (CDH6) | NM_004932.2 |
| Cadherin 7, type 2 (CDH7) | NM_004361.2 NM_033646.1 |
| canalicular multidrug resistance protein | X96395.2 |
| canalicular multispecific organic anion transporter (cMOAT) | U63970.1 |
| | U49248.1 |
| Ccanalicular multispecific organic anion transporter 2 (CMOAT2) | AF083552.1 |
| CD163 molecule-like 1 (CD163L1) | NM_174941.4 |
| CD4 molecule (CD4) | NM_001195015.1 |
| | NM_001195017.1 |
| | NM_001195016.1 NM_001195014.1 |
| | NM_000616.4 |
| CD47 molecule | BC010016.2 BT006907.1 |
| | BC037306.1 |
| | BC012884.1 |
| | NM_198793.2 NM_001777.3 |
| cellular proto-oncogene (c-mer) | U08023.1 |
| ceptor for advanced glycosylation end-products intron 4&9 variant (AGER) | AY755622.1 |
| Cholinergic receptor, nicotinic, alpha 1 (CHRNA1) | NM_000079.3 |
| | NM_001039523.2 |
| | AK315312.1 |
| Cholinergic receptor, nicotinic, alpha 10 (CHRNA10) | NM_020402.2 |
| Cholinergic receptor, nicotinic, alpha 2 (CHRNA2) | BC153866.1 |
| | NM_000742.3 |
| Cholinergic receptor, nicotinic, alpha 3 (CHRNA3) | BC002996.1 |
| | BC098443.1 |
| | BC000513.2 |
| | BC001642.2 |
| | BC006114.1 |
| | NM_001166694.1 NM_000743.4 |
| | BT006897.1 BT006646.1 |
| Cholinergic receptor, nicotinic, alpha 4 (CHRNA4) | BC096293.3 GI:109731542 |
| | BC096290.1 BC096292.1 |
| | BC096291.1 |
| | NM_000744.5 |
| | AB209359.1 |
| Cholinergic receptor, nicotinic, alpha 5 (CHRNA5) | BC033639.1 |
| | NM_000745.3 |
| Cholinergic receptor, nicotinic, alpha 6 (CHRNA6) | BC014456.1 |
| | NM_001199279.1 NM_004198.3 |
| | AK313521.1 |
| Cholinergic receptor, nicotinic, alpha 7 (CHRNA7) | BC037571.1 |
| | NM_000746.4 NM_001190455.1 |
| Cholinergic receptor, nicotinic, alpha 9 (CHRNA9) | BC113549.1 |
| | BC113575.1 |
| | NM_017581.2 |

TABLE 3-continued

List of Membrane-Bound Receptors

| Membrane-bound Receptor Name | mRNA ID |
|---|---|
| Cholinergic receptor, nicotinic, beta 1 (CHRNB1) | BC023553.2 |
| | BC011371.1 |
| | NM_000747.2 |
| Cholinergic receptor, nicotinic, beta 2 (CHRNB2) | BC075041.2 |
| | BC075040.2 |
| | AK313470.1 |
| | NM_000748.2 |
| Cholinergic receptor, nicotinic, beta 3 (CHRNB3) | BC069788.1 |
| | BC069703.1 |
| | BC069681.1 |
| | NM_000749.3 |
| Cholinergic receptor, nicotinic, beta 4 (CHRNB4) | BC096080.1 BC096082.1 |
| | NM_000750.3 |
| cholinergic receptor, nicotinic, delta (CHRND) | BC093925.1 BC093923.1 |
| | NM_000751.1 |
| Cholinergic receptor, nicotinic, epsilon (CHRNE) | NM_000080.3 |
| Cholinergic receptor, nicotinic, gamma (CHRNG) | BC111802.1 |
| | NM_005199.4 |
| CRB1 isoform II precursor | AY043325.1 |
| Cstic fibrosis transmembrane conductance regulator (ATP-binding cassette sub-family C, member 7) (CFTR) | NM_000492.3 |
| C-type lectin domain family 4, member A (CLEC4A) | NM_194450.2 NM_194448.2 |
| | NM_194447.2 |
| | NM_016184.3 |
| enaptin | AF535142.1 |
| Eph-related receptor transmembrane ligand Elk-L3 precursor (Elk-L3) | U62775.1 |
| Fc receptor related gene | DQ021957.1 |
| Fibroblast growth factor receptor 3 (FGFR3) | NM_022965.3 |
| Fibroblast growth factor receptor 4 (FGFR4) | NM_022963.2 |
| Fms-related tyrosine kinase 3 (FLT3) | NM_004119.2 |
| Follicle stimulating hormone receptor (FSHR) | AY429104.1 |
| | S59900.1 |
| | M95489.1 M65085.1 |
| | BC118548.1 |
| | BC096831.1 |
| | BC125270.1 |
| | NM_181446.2 NM_000145.3 |
| | X68044.1 |
| G protein-coupled receptor 155 (GPR155) | BC035037.1 |
| | BC028730.1 |
| | NM_001033045.2 NM_152529.5 |
| GABA-A receptor delta subunit (GABRD) | AF016917.1 |
| GABA-A receptor epsilon subunit | U66661.1 |
| GABAA receptor gamma 3 subunit | S82769.1 |
| GABA-A receptor pi subunit | U95367.1 |
| GABAA receptor subunit alpha4 | U30461.1 |
| GABA-A receptor theta subunit (THETA) | AF189259.1 |
| | AF144648.1 |
| GABA-A receptor, beta 1 subunit | X14767.1 |
| GABA-A receptor, gamma 2 subunit | X15376.1 |
| GABA-benzodiazepine receptor alpha-5-subunit (GABRA5) | L08485.1 |
| Gamma-aminobutyric acid (GABA) A receptor, alpha 1 (GABRA1) | BC030696.1 |
| | NM_001127648.1 NM_001127647.1 |
| | NM_001127646.1 |
| | NM_001127645.1 |
| | NM_001127644.1 |
| | NM_001127643.1 |
| | NM_000806.5 |
| Gamma-aminobutyric acid (GABA) A receptor, alpha 2 (GABRA2) | BC022488.1 |
| | NM_001114175.1 |
| | NM_000807.2 |
| Gamma-aminobutyric acid (GABA) A receptor, alpha 3 (GABRA3) | BC028629.1 |
| | NM_000808.3 |
| Gamma-aminobutyric acid (GABA) A receptor, alpha 4 (GABRA4) | BC035055.1 |
| | NM_001204267.1 NM_001204266.1 |
| | NM_000809.3 |
| Gamma-aminobutyric acid (GABA) A receptor, alpha 5 (GABRA5) | BC113422.1 |
| | BC111979.1 |
| | BT009830.1 |
| | NM_001165037.1 NM_000810.3 |
| Gamma-aminobutyric acid (GABA) A receptor, alpha 6 (GABRA6) | BC099641.3 |
| | BC096241.3 |
| | BC099640.3 |
| | BC096242.3 |
| | NM_000811.2 |

TABLE 3-continued

List of Membrane-Bound Receptors

| Membrane-bound Receptor Name | mRNA ID |
|---|---|
| Gamma-aminobutyric acid (GABA) A receptor, beta 1 (GABRB1) | BC022449.1 |
| | NM_000812.3 |
| Gamma-aminobutyric acid (GABA) A receptor, beta 2 (GABRB2) | BC105639.1 |
| | BC099719.1 BC099705.1 |
| | NM_021911.2 NM_000813.2 |
| gamma-aminobutyric acid (GABA) A receptor, beta 3 (GABRB3) | BC010641.1 |
| | NM_001191320.1 NM_021912.4 |
| | NM_001191321.1 |
| | NM_000814.5 |
| Gamma-aminobutyric acid (GABA) A receptor, delta (GABRD) | BC033801.1 |
| | NM_000815.4 |
| Gamma-aminobutyric acid (GABA) A receptor, epsilon (GABRE) | BC059376.1 |
| | BC047108.1 |
| | BC026337.1 |
| | NM_004961.3 |
| Gamma-aminobutyric acid (GABA) A receptor, gamma 1 (GABRG1) | BC031087.1 |
| | NM_173536.3 |
| Gamma-aminobutyric acid (GABA) A receptor, gamma 2 (GABRG2) | BC074795.2 GI:50959646 |
| | BC059389.1 |
| | NM_198903.2 |
| | NM_000816.3 |
| | NM_198904.2 |
| Gamma-aminobutyric acid (GABA) A receptor, gamma 3 (GABRG3) | NM_033223.4 |
| Gamma-aminobutyric acid (GABA) A receptor, pi (GABRP) | BC074810.2 |
| | BC069348.1 |
| | BC074865.2 |
| | BC109105.1 BC109106.1 |
| | NM_014211.2 |
| Gamma-aminobutyric acid (GABA) receptor, rho 1 (GABRR1) | NM_002042.3 |
| Gamma-aminobutyric acid (GABA) receptor, rho 2 (GABRR2) | BC130352.1 |
| | BC130354.1 |
| | NM_002043.2 |
| gamma-aminobutyric acid (GABA) receptor, rho 3 (GABRR3) | NM_001105580.1 |
| gamma-aminobutyric acid (GABA) receptor, theta (GABRQ) | BC109210.1 |
| | BC109211.1 |
| | NM_018558.2 |
| gamma-aminobutyric acid A receptor beta 2 isoform 3 (GABRB2) | GU086164.1 |
| | GU086163.1 |
| gamma-aminobutyric acid A receptor beta 2 subunit (GABR2) | S67368.1 |
| gamma-aminobutyric acid A receptor, alpha 2 precursor | AB209295.1 |
| gamma-aminobutyric acid receptor type A rho-1 subunit (GABA-A rho-1) | M62400.1 |
| gamma-aminobutyric acid type A receptor alpha 6 subunit | S81944.1 |
| gamma-aminobutyric acidA receptor alpha 2 subunit | S62907.1 |
| gamma-aminobutyric acidA receptor alpha 3 subunit | S62908.1 |
| gamma-aminobutyric-acid receptor alpha-subunit | X13584.1 |
| glycine receptor alpha 3 subunit | U93917.1 |
| glycine receptor alpha2 subunit B (GLRA2) | AY437084.1 AY437083.1 |
| glycine receptor beta subunit precursor (GLRB) | AF094755.1 AF094754.1 |
| Glycine receptor, alpha 1 (GLRA1) | BC114967.1 BC114947.1 |
| | BC074980.2 |
| | NM_001146040.1 NM_000171.3 |
| Glycine receptor, alpha 2 (GLRA2) | BC032864.2 |
| | NM_001171942.1 |
| | NM_001118886.1 |
| | NM_001118885.1 |
| | NM_002063.3 |
| Glycine receptor, alpha 3 (GLRA3) | BC036086.1 |
| | NM_006529.2 NM_001042543.1 |
| Glycine receptor, alpha 4 (GLRA4) | NM_001172285.1 |
| | NM_001024452.2 |
| glycine receptor, beta (GLRB) | BC032635.1 |
| | NM_001166061.1 NM_000824.4 |
| | NM_001166060.1 |
| GP2 | D38225.1 |
| gpVI mRNA for platelet glycoprotein VI | AB035073.1 |
| H1 histamine receptor | Z34897.1 |
| HEK2 protein tyrosine kinase receptor | X75208.1 |
| high affinity IgE receptor alpha-subunit (FcERI) | X06948.1 |
| HLA | D32131.1 D32129.1 |
| HLA class I locus C heavy chain | X58536.1 |
| HLA class II DR-beta (HLA-DR B) | X12544.1 |
| HLA classII histocompatibility antigen alpha-chain | X00452.1 |
| HLA-A26 (HLA class-I heavy chain) | D32130.1 |
| HLA-DR antigens associated invariant chain (p33) | X00497.1 |
| holinergic receptor, nicotinic, delta polypeptide(CHRND) | AK315297.1 |
| HPTP (protein tyrosine phosphatase delta) | X54133.1 |

TABLE 3-continued

List of Membrane-Bound Receptors

| Membrane-bound Receptor Name | mRNA ID |
|---|---|
| HPTP (protein tyrosine phosphatase epsilon) | X54134.1 |
| HPTP (protein tyrosine phosphatase zeta) | X54135.1 |
| HPTP alpha mRNA for protein tyrosine phosphatase alpha | X54130.1 |
| HPTP beta (protein tyrosine phosphatase beta) | X54131.1 |
| -hydroxytryptamine (serotonin) receptor 3 family member D (HTR3D) | NM_001163646.1 |
| ICAM-3 | X69819.1 |
| IL12 receptor component | U03187.1 |
| IL-4-R | X52425.1 |
| immunoglobulin receptor precursor | AY046418.1 |
| insulin-like growth factor I receptor | X04434.1 |
| integrin associated protein | Z25521.1 |
| Killer cell lectin-like receptor subfamily D, member 1 (KLRD1) | NM_001114396.1 |
| KIR (cl-11) NK receptor precursor protein | U30274.1 |
|  | U30273.1 |
|  | U30272.1 |
| large conductance calcium- and voltage-dependent potassium channel alpha subunit (MaxiK) | U11058.2 |
| large-conductance calcium-activated potassium channel beta subunit (KCNMB4) | AF160967.1 |
| leucine-rich glioma-inactivated protein precursor (LGI1) | AF055636.1 |
| Leukocyte immunoglobulin-like receptor, subfamily A (with TM domain), member 2 (LILRA2) | NM_001130917.1 |
|  | NM_006866.2 |
| Leukocyte immunoglobulin-like receptor, subfamily A (without TM domain), member 3 (LILRA3) | NM_006865.3 |
|  | NM_001172654.1 |
| lycine receptor beta subunit (GLRB) | U33267.1 |
| lymphocte activation marker Blast-1 | X06341.1 |
| M-ABC2 protein (M-ABC2), nuclear gene for mitochondrial product | AF216833.1 |
| Major histocompatibility complex, class I, A (HLA-A) | NM_002116.6 |
| Major histocompatibility complex, class I, B (HLA-B) | NM_005514.6 |
| Major histocompatibility complex, class I, C (HLA-C) | NM_002117.4 |
| Major histocompatibility complex, class I, E (HLA-E) | NM_005516.5 |
| Major histocompatibility complex, class I, G (HLA-G), | NM_002127.5 |
| MAT8 protein | X93036.1 |
| MCTP1L mRNA | AY656715.1 |
| MCTP1S | AY656716.1 |
| MCTP2 | AY656717.1 |
| membrane glycoprotein P (mdr3) | M23234.1 |
| Mint1 | AF029106.1 |
| mono ATP-binding cassette protein | AB013380.1 GI:12248754 |
| MRP5 | AB019002.1 |
| MRP6 (MRP6) | AF076622.1 |
| MT-ABC transporter (MTABC) | AF076775.1 |
| multidrug resistance protein 1 | EU854148.1 |
|  | EU852583.1 |
|  | AB208970.1 |
| multidrug resistance protein 3 (ABCC3) | Y17151.2 |
| multidrug resistance protein 5 (MRP5) | U83661.2 |
| multidrug resistance-associated protein (ABCC4) | AY081219.1 |
| multidrug resistance-associated protein (MRP) | L05628.1 |
| multidrug resistance-associated protein 3 (MRP3) | AF085690.1 |
|  | AF085691.1 |
| Multidrug resistance-associated protein 5 variant protein | AB209454.1 |
| multidrug resistance-associated protein 7 (SIMRP7) | AY032599.1 |
| multidrug resistance-associated protein homolog MRP3 (MRP3) | AF009670.1 |
| multidrug resistance-associated protein(MRP)-like protein-2 (MLP-2) | AB010887.1 |
| multiple C2 domains, transmembrane 1 (MCTP1) | BC030005.2 |
|  | NM_001002796.2 |
|  | NM_024717.4 |
| multiple C2 domains, transmembrane 2 (MCTP2) | BC111024.1 |
|  | BC041387.1 |
|  | BC025708.1 |
|  | BC131527.1 |
|  | NM_001159644.1 |
|  | NM_018349.3 |
|  | NM_001159643.1 |
| myeloid cell leukemia ES variant (MCL1) | FJ917536.1 |
| neuregulin 4 (NRG4) | AM392365.1 |
|  | AM392366.1 |
| neuronal nAChR beta-3 subunit | X67513.1 |
| neuronal nicotinic acetylcholine alpha10 subunit (NACHRA10 gene) | AJ278118.1 |
|  | AJ295237.1 |
| neuronal nicotinic acetylcholine receptor alpha-3 subunit | X53559.1 |
| nicotinic acetylcholine alpha-7 subunit (CHRNA7 gene) | X70297.1 AJ586911.1 |
| neuronal nicotinic acetylcholine receptor beta-2 subunit | X53179.1 |
| nicotinic acetylcholine receptor alpha 3 subunit precursor | M86383.1 |
| nicotinic acetylcholine receptor alpha 4 subunit (nAChR) | L35901.1 |

TABLE 3-continued

List of Membrane-Bound Receptors

| Membrane-bound Receptor Name | mRNA ID |
|---|---|
| nicotinic acetylcholine receptor alpha 9 subunit (NACHRA9 gene) | AJ243342.1 |
| nicotinic acetylcholine receptor alpha2 subunit precursor | U62431.1 |
| | Y16281.1 |
| nicotinic acetylcholine receptor alpha3 subunit precursor | U62432.1 |
| | Y08418.1 |
| nicotinic acetylcholine receptor alpha4 subunit precursor | U62433.1 |
| | Y08421.1 |
| | X87629.1 |
| nicotinic acetylcholine receptor alpha5 subunit precursor | U62434.1 |
| | Y08419.1 |
| nicotinic acetylcholine receptor alpha6 subunit precursor | U62435.1 |
| | Y16282.1 |
| nicotinic acetylcholine receptor alpha7 subunit precursor | U62436.1 |
| nicotinic acetylcholine receptor alpha7 subunit precursor | Y08420.1 |
| nicotinic acetylcholine receptor beta2 subunit precursor | U62437.1 |
| nicotinic acetylcholine receptor beta2 subunit precursor | Y08415.1 |
| nicotinic acetylcholine receptor beta3 subunit precursor | U62438.1 |
| nicotinic acetylcholine receptor beta3 subunit precursor | Y08417.1 |
| nicotinic acetylcholine receptor beta4 subunit precursor | U62439.1 |
| nicotinic acetylcholine receptor beta4 subunit precursor | Y08416.1 |
| nicotinic acetylcholine receptor subunit alpha 10 | AF199235.2 |
| nicotinic cholinergic receptor alpha 7 (CHRNA7) | AF385585.1 |
| nicotinic receptor alpha 5 subunit | M83712.1 |
| nicotinic receptor beta 4 subunit | X68275.1 |
| on-erythroid band 3-like protein (HKB3) | X03918.1 |
| p58 natural killer cell receptor precursor | U24079.1 |
| | U24078.1 |
| | U24077.1 |
| | U24076.1 |
| | U24075.1 |
| | U24074.1 |
| peptide transporter (TAP1) | L21207.1 L21206.1 |
| | L21205.1 |
| | L21204.1 |
| peroxisomal 70 kD membrane protein | M81182.1 |
| peroxisomal membrane protein 69 (PMP69) | AF009746.1 |
| P-glycoprotein | AY090613.1 |
| P-glycoprotein (ABCB1) | AF399931.1 AF319622.1 |
| P-glycoprotein (mdr1) | AF016535.1 |
| P-glycoprotein (PGY1) | M14758.1 |
| P-glycoprotein ABCB5 | AY234788.1 |
| Phospholipase A2 receptor 1, 180 kDa (PLA2R1) | NM_001007267.2 |
| PMP70 | X58528.1 |
| Potassium voltage-gated channel, shaker-related subfamily, member 5 (KCNA5) | NM_002234.2 |
| potassium voltage-gated channel, shaker-related subfamily, member 7 (KCNA7) | NM_031886.2 |
| precursor of epidermal growth factor receptor | X00588.1 |
| pre-T cell receptor alpha-type chain precursor | U36759.1 |
| protein tyrosine phosphatase hPTP-J precursor | U73727.1 |
| Protein tyrosine phosphatase, receptor type, F (PTPRF) 2 | NM_006504.4 NM_130435.3 |
| | NM_002840.3 |
| | NM_130440.2 |
| Protein tyrosine phosphatase, receptor type, G (PTPRG) | NM_002841.3 |
| Protein tyrosine phosphatase, receptor type, H (PTPRH) | NM_001161440.1 NM_002842.3 |
| Protein tyrosine phosphatase, receptor type, J (PTPRJ) | NM_002843.3 NM_001098503.1 |
| Protein tyrosine phosphatase, receptor type, K (PTPRK) | NM_001135648.1 NM_002844.3 |
| Protein tyrosine phosphatase, receptor type, M (PTPRM) | NM_001105244.1 NM_002845.3 |
| Protein tyrosine phosphatase, receptor type, N polypeptide 2 (PTPRN2) | NM_001199764.1 NM_002846.3 |
| | NM_001199763.1 |
| | NM_130843.2 NM_002847.3 |
| | NM_130842.2 |
| Protein tyrosine phosphatase, receptor type, R (PTPRR) | NM_130846.1 NM_002849.2 |
| Protein tyrosine phosphatase, receptor type, T (PTPRT) | NM_007050.5 NM_133170.3 |
| Protein tyrosine phosphatase, receptor type, U (PTPRU) | NM_001195001.1 NM_133178.3 |
| | NM_005704.4 |
| | NM_133177.3 |
| protein tyrosine phosphatase, receptor type, U (PTPRU) | |
| protocadherin 1 (PCDH1) | NM_002587.3 |
| | NM_032420.2 |
| Protocadherin 8 (PCDH8), transcript variant 2 | NM_032949.2 |
| | NM_002590.3 |
| Protocadherin 9 (PCDH9) | NM_203487.2 NM_020403.4 |
| protocadherin alpha 1 (PCDHA1) | NM_031411.1 |
| Protocadherin alpha 10 (PCDHA10) | NM_031860.1 |
| protocadherin alpha 6 (PCDHA6) | NM_031849.1 |

TABLE 3-continued

List of Membrane-Bound Receptors

| Membrane-bound Receptor Name | mRNA ID |
|---|---|
| protocadherin gamma subfamily A, 1 (PCDHGA1) | NM_018912.2 NM_031993.1 |
| protocadherin gamma subfamily A, 10 (PCDHGA10) | NM_018913.2 NM_032090.1 |
| Protocadherin gamma subfamily A, 11 (PCDHGA11) | NM_032092.1 NM_032091.1 NM_018914.2 |
| Protocadherin gamma subfamily A, 12 (PCDHGA12) | NM_032094.1 NM_003735.2 |
| Protocadherin gamma subfamily A, 2 (PCDHGA2) | NM_032009.1 NM_018915.2 |
| protocadherin gamma subfamily A, 3 (PCDHGA3) | NM_018916.3 |
| protocadherin gamma subfamily A, 3 (PCDHGA3) | NM_032011.1 |
| protocadherin gamma subfamily A, 4 (PCDHGA4) | NM_032053.1 NM_018917.2 |
| protocadherin gamma subfamily A, 5 (PCDHGA5) | NM_032054.1 NM_018918.2 |
| protocadherin gamma subfamily A, 6 (PCDHGA6), transcript variant 2 | NM_032086.1 NM_018919.2 |
| protocadherin gamma subfamily A, 7 (PCDHGA7) | NM_018920.2 NM_032087.1 |
| Protocadherin gamma subfamily A, 8 (PCDHGA8) | NM_032088.1 NM_014004.2 |
| protocadherin gamma subfamily A, 9 (PCDHGA9) | NM_018921.2 NM_032089.1 |
| protocadherin gamma subfamily B, 1 (PCDHGB1) | NM_018922.2 NM_032095.1 |
| protocadherin gamma subfamily B, 2 (PCDHGB2) | NM_018923.2 NM_032096.1 |
| protocadherin gamma subfamily B, 3 (PCDHGB3) | NM_018924.2 NM_032097.1 |
| Protocadherin gamma subfamily B, 4 (PCDHGB4) | NM_032098.1 NM_003736.2 |
| protocadherin gamma subfamily B, 5 (PCDHGB5) | NM_032099.1 NM_018925.2 |
| protocadherin gamma subfamily B, 6 (PCDHGB6) | NM_032100.1 NM_018926.2 |
| Protocadherin gamma subfamily B, 7 (PCDHGB7) | NM_032101.1 NM_018927.2 |
| Protocadherin gamma subfamily C, 3 (PCDHGC3) | NM_032403.1 NM_032402.1 NM_002588.2 |
| protocadherin gamma subfamily C, 4 (PCDHGC4) | NM_018928.2 NM_032406.1 |
| protocadherin gamma subfamily C, 5 (PCDHGC5) | NM_032407.1 NM_018929.2 |
| PSF-2 | M74447.1 |
| transmembrane receptor IL-1Rrp | U43672.1 |
| RING4 | X57522.1 |
| Sarcoglycan, zeta (SGCZ) | NM_139167.2 |
| SB classII histocompatibility antigen alpha-chain | X00457.1 |
| SH2 domain-containing phosphatase anchor protein 1c (SPAP1) | AF319440.1 |
| SMRP | AB005659.1 |
| Solute carrier family 4, sodium bicarbonate cotransporter, member 4 (SLC4A4) | NM_001134742.1 NM_003759.3 NM_001098484.2 |
| Solute carrier family 6 (neurotransmitter transporter, noradrenalin), member 2 (SLC6A2) | NM_001172504.1 NM_001172502.1 NM_001172501.1 NM_001043.3 |
| sulfonylurea receptor (SUR1) | U63421.1 AB209084.1 AF087138.1 |
| sushi-repeat-containing protein precursor (SRPX) | U78093.1 |
| Synaptotagmin XIII (SYT13) | NM_020826.2 |
| Synaptotagmin XV (SYT15) | NM_031912.4 NM_181519.2 |
| T200 leukocyte common antigen (CD45, LC-A) | Y00062.1 |
| TAP2B | Z22935.1 |
| TAP2E | Z22936.1 |
| TAPL (TAP-Like), | AB112583.1 AB112582.1 AB045381.2 |
| thyroperoxidase | Y00406.1 |
| tissue-type tonsil IFGP6 | AY212514.1 |
| trans-golgi network glycoprotein 48 (TGN) | AF027515.1 |
| trans-golgi network glycoprotein 51 (TGN) | AF027516.1 |
| Transporter 1, ATP-binding cassette, sub-family B (MDR/TAP) (TAP1) | BC014081.2 NM_000593.5 AY523971.2 AY523970.1 |
| Transporter 2, ATP-binding cassette, sub-family B (MDR/TAP) (TAP2), | AF078671.1 AF105151.1 NM_018833.2 NM_000544.3 AK223300.1 AK222823.1 AB073779.1 AB208953.1 |
| ATP-binding cassette transporter sub-family C member 13 (ABCC13) | AY344117.1 |
| tyrosine kinase (FER) | J03358.1 |
| Ubiquinol-cytochrome c reductase, Rieske iron-sulfur polypeptide 1 | NM_006003.2 |

TABLE 3-continued

List of Membrane-Bound Receptors

| Membrane-bound Receptor Name | mRNA ID |
|---|---|
| (UQCRFS1) | BC067832.1 |
|  | BC010035.2 |
|  | BC000649.1 |
| ulfonylurea receptor (SUR1) | L78207.1 |

Cell-Type Specific Polypeptides

As used herein, the term "cell-type specific polypeptide" refers to a polypeptide that is expressed in a cell having a particular phenotype (e.g., a muscle cell) but is not generally expressed in other cell types with different phenotypes. For example, MyoD is expressed specifically in muscle cells but not in non-muscle cells, thus MyoD is a cell-type specific polypeptide. As another example, albumin is expressed in hepatocytes and is thus an hepatocyte-specific polypeptide.

Such cell-specific polypeptides are well known in the art or can be found using a gene array analysis and comparison of at least two different cell types. Methods for gene expressional array analysis is well known in the art.

Differentiation factors, reprogramming factors and transdifferentiation factors are further discussed herein in their appropriate sub-sections.

Death Receptors and Death Receptor Ligands

By "death receptor" is meant a receptor that induces cellular apoptosis once bound by a ligand. Death receptors include, for example, tumor necrosis factor (TNF) receptor superfamily members having death domains (e.g., TNFR1, Fas, DR3, 4, 5, 6) and TNF receptor superfamily members without death domains LTbetaR, CD40, CD27, HVEM. Death receptors and death receptor ligands are well known in the art or are discussed herein.

The synthetic, modified RNAs described herein can encode for death receptors to be expressed on the surface of a cell to enhance the vulnerability of a cell to apoptosis. The death ligand can also be encoded or can be provided e.g., at a tumor site. This is particularly useful in the treatment of cancer, where cells evade apoptosis and continue to divide. Alternatively, the synthetic, modified RNAs or compositions thereof can encode for a death receptor ligand, which will induce apoptosis in cells that express a cell surface death receptor and can increase the efficiency of programmed cell death in targeted cells of a subject.

Some non-limiting examples of death receptors include FAS (CD95, Apo1), TNFR1 (p55, CD120a), DR3 (Apo3, WSL-1, TRAMP, LARD), DR4, DR5 (Apo2, TRAIL-R2, TRICK2, KILLER), CAR1, and the adaptor molecules FADD, TRADD, and DAXX. Some non-limiting examples of death receptor ligands include FASL (CD95L), TNF, lymphotoxin alpha, Apo3L (TWEAK), and TRAIL (Apo2L).

Mitogen Receptors

The synthetic, modified RNAs described herein can be used to express a mitogen receptor on a cell surface. Activation of a mitogen receptor with the mitogen induces cell growth and/or differentiation of the cell.

Mitogen receptors include those that bind ligands including, but not limited to: insulin, insulin-like growth factor (e.g., IGF1, IGF2), platelet derived growth factor (PDGF), epidermal growth factor (EGF), vascular endothelial growth factor (VEGF), nerve growth factor (NGF), fibroblast growth factor (FGF), bone morphogenic proteins (BMPs), granulocyte colony-stimulating factor (G-CSF), granulocyte-macrophage colony-stimulating factor (GM-CSF), hepatocyte growth factor (HGF), transforming growth factor (TGF)-alpha and -beta, among others.

In addition, cytokines that promote cell growth can also be encoded by synthetic, modified RNAs herein. For example, cytokines such as erythropoietin, thrombopoietin and other cytokines from the IL-2 sub-family tend to induce cell proliferation and growth.

Protein Therapeutics

Synthetic, modified RNAs as described herein can also be used to express protein therapeutically in cells by either administration of a synthetic, modified RNA composition to an individual or by administering a synthetic, modified RNA to cells that are then introduced to an individual. In one aspect, cells can be transfected with a modified RNA to express a therapeutic protein using an ex vivo approach in which cells are removed from a patient, transfected by e.g., electroporation or lipofection, and re-introduced to the patient. Continuous or prolonged administration in this manner can be achieved by electroporation of blood cells that are re-infused to the patient.

Some exemplary protein therapeutics include, but are not limited to: insulin, growth hormone, erythropoietin, granulocyte colony-stimulating factor (G-CSF), thrombopoietin, clotting factor VII, Factor IX, interferon, glucocerebrosidase, anti-HER2 monoclonal antibody, and Etanercept, among others.

As used in this specification and the appended claims, the singular forms "a," "an," and "the" include plural references unless the context clearly dictates otherwise. Thus for example, references to "the method" includes one or more methods, and/or steps of the type described herein and/or which will become apparent to those persons skilled in the art upon reading this disclosure and so forth. In addition, the term 'cell' can be construed as a cell population, which can be either heterogeneous or homogeneous in nature, and can also refer to an aggregate of cells.

It is understood that the foregoing detailed description and the following examples are illustrative only and are not to be taken as limitations upon the scope of the invention. Various changes and modifications to the disclosed embodiments, which will be apparent to those of skill in the art, may be made without departing from the spirit and scope of the present invention. Further, all patents, patent applications, and publications identified are expressly incorporated herein by reference for the purpose of describing and disclosing, for example, the methodologies described in such publications that might be used in connection with the present invention. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents are based on the information available to the applicants

EXAMPLES

Currently, clinical applications using induced pluripotent stem (iPS) cells are impeded by low efficiency of iPS derivation, and the use of protocols that permanently modify the genome to effect cellular reprogramming. Moreover, safe, reliable, and effective means of directing the fate of patient-specific iPS cells towards clinically useful cell types are lacking. Described herein are novel, non-mutagenic strategies for altering cellular phenotypes, such as reprogramming cell fate, based on the administration of synthetic, modified mRNAs that are modified to overcome innate cellular anti-viral responses. The compositions and approaches described herein can be used to reprogram multiple human cell types to pluripotency with surprising and unexpected efficiencies that greatly surpass established protocols. Also described herein are novel compositions and methods for directing the fate of cells towards clinically useful cell types, and a non-limiting example that demonstrates that this technology can be used to efficiently direct the differentiation of RNA-induced pluripotent stem (RiPS) cells into terminally differentiated myogenic cells. Thus, the compositions and methods described herein represent safe, highly efficient strategies for altering cellular developmental potentials, such as somatic cell reprogramming and directing differentiated cell fates, that have broad applicability for basic research, disease modeling and regenerative and personalized medicine.

Experimental Procedures

Construction of IVT Templates

The pipeline for production of IVT template constructs and subsequent RNA synthesis is schematized in FIG. 1. The oligonucleotide sequences used in the construction of IVT templates are shown in Table 4. All oligos were synthesized by Integrated DNA Technologies (Coralville, Iowa). ORF PCRs were templated from plasmids bearing human KLF4, c-MYC, OCT4, SOX2, human ES cDNA (LIN28), Clontech pIRES-eGFP (eGFP), pRVGP (d2eGFP) and CMV-MyoD from Addgene. The ORF of the low-stability nuclear GFP was constructed by combining the d2eGFP ORF with a 3' nuclear localization sequence. PCR reactions were performed using HiFi Hotstart (KAPA Biosystems, Woburn, Mass.) per the manufacturer's instructions. Splint-mediated ligations were carried out using Ampligase Thermostable DNA Ligase (Epicenter Biotechnologies, Madison, Wis.). UTR ligations were conducted in the presence of 200 nM UTR oligos and 100 nM splint oligos, using 5 cycles of the following annealing profile: 95° C. for 10 seconds; 45° C. for 1 minute; 50° C. for 1 minute; 55° C. for 1 minute; 60° C. for 1 minute. A phosphorylated forward primer was employed in the ORF PCRs to facilitate ligation of the top strand to the 5' UTR fragment. The 3' UTR fragment was also 5'-phosphorylated using polynucleotide kinase (New England Biolabs, Ipswich, Mass.). All intermediate PCR and ligation products were purified using QIAquick spin columns (Qiagen, Valencia, Calif.) before further processing. Template PCR amplicons were sub-cloned using the pcDNA 3.3-TOPO TA cloning kit (Invitrogen, Carlsbad, Calif.). Plasmid inserts were excised by restriction digest and recovered with SizeSelect gels (Invitrogen) before being used to template tail PCRs.

5' and 3' UTR oligos are ligated to the top strand of gene-specific ORF amplicons to produce a basic template construct for cloning. Underlined bases in the 5' UTR oligo sequence indicate the upstream T7 promoter, and in the 3' UTR oligo sequence show downstream restriction sites, introduced to facilitate linearization of template plasmids. Template PCR primers are used to amplify ligation products for sub-cloning. Tail PCR primers are used to append an oligo(dT) sequence immediately after the 3' UTR to drive templated addition of a poly(A) tail during IVT reactions. Gene-specific ORF primers are used to capture the coding region (minus the start codon) from cDNA templates. Splint oligos mediate ligation of UTR oligos to the top strand of ORF amplicons.

TABLE 4

Oligonucleotides for IVT template construction (SEQ ID NOs: 1429-1466, respectively, in order of appearance)

| | ORF Forward Primer | ORF Reverse Primer |
| --- | --- | --- |
| eGFP | GRGAGCAAGGGCGAGGAGCTGTT | TTACTGTACAGCTCGTCCATGCCGAGA |
| d2eGFP | GTGAGCAAGGGCGAGGAGCTGTT | CTACACATTGATCCTAGCAGAAGCACAGGCT |
| KLF4 | GCTGTCAGCGACGCGCTGCTC | TTAAAAATGCCTCTTCATGTGTAAGGCGAGGT |
| c-MYC | CCCCTCAACGTTAGCTTCACCAACAGG | TTACGCACAAGAGTTCCGTAGCTGTTCA |
| OCT4 | GCGGGACACCTGGCTTCGGATTTC | TCAGTTTGAATGCATGGGAGAGCCCAGA |
| SOX2 | TACAACATGATGGAGACGGAGCTGAAGC | TCACATGTGTGAGAGGGGCAGTGTG |
| LIN28 | GGCTCCGTGTCCAACCAG | TCAATTCTGTGCCTCCGG |
| MYOD | GAGCTTCTATCGCCGCCACTCC | TCAAAGCACCTGATAAATCGCATTGG |
| | 5' Splint Oligo | 3' Splint Oligo |
| eGFP | TCCTCGCCCTTGCTCACCATGGTGGCTCTTATATTTCTTCTT | CCCGCAGAAGGCAGCTTACTTGTACAGCTCGTCCATGC |
| d2eGFP | TCCTCGCCCTTGCTCACCATGGTGGCTCTTATATTTCTTCTT | CCCGCAGAAGGCAGCCTACACATTGATCCTAGCAGA |
| KLF4 | GCGCGTCGCTGACAGCCATGGTGGCTCTTATATTTCTTCTT | CCCGCAGAAGGCAGCTTAAAAATGCCTCTTCATGTGTAA |

TABLE 4-continued

Oligonucleotides for IVT template construction (SEQ ID NOs: 1429-1466, respectively, in order of appearance)

| c-MYC | GTGAAGCTAACGTTGAGGGGCATGGTGGCTCTTATATTTCTTCTT | CCCGCAGAAGGCAGCTTACGCACAAGAGTTCCGTAG |
|---|---|---|
| OCT4 | AAGCCAGGTGTCCCGCCATGGTGGCTCTTATATTTCTTCTT | CCCGCAGAAGGCAGCTCAGTTTGAATGCATGGGAG |
| SOX2 | CTCCGTCTCCATCATGTTGTACATGGTGGCTCTTATATTTCTTCTT | CCCGCAGAAGGCAGCTCACATGTGTGAGAGGGGC |
| LIN28 | CTGGTTGGACACGGAGCCCATGGTGGCTCTTATATTTCTTCTT | CCCGCAGAAGGCAGCTCAATTCTGTGCCTCCGG |
| MYOD | TGGCGGCGATAGAAGCTCCATGGTGGCTCTTATATTTCTTCTT | CCCGCAGAAGGCAGCTCAAAGCACCTGATAAATCGCATTGG |

| UTR Oligos | | |
|---|---|---|
| 5' UTR | TTGGACCCTCGTACAGAAGC<u>TAATACGACTCACTATAGGG</u>AAATAAGAGAGAAAAGAAGAGTAAGAAGAAATATAAGAGCCACCATG | |
| 3' UTR | GCTGCCTTCTGCGGGGCTTGCCTTCTGGCCATGCCCTTCTTCTCTCCCTTGCACCTGTACCTCTTGGTCTTTGAATAAAGCCTGAGTAGGAAGTGAGGG<u>TCTAGAACTAGTGTCGAC</u>GC | |

| | Forward Primer | Reverse Primer |
|---|---|---|
| Template PCR | TTGGACCCTCGTACAGAAGCTAATACG | GCGTCGACACTAGTTCTAGACCCTCA |
| Tail PCR | TTGGACCCTCGTACAGAAGCTAATACG | T$_{120}$CTTCCTACTCAGGCTTTATTCAAAGACCA |

Synthesis of Synthetic, Modified RNA

RNA was synthesized with the MEGAscript T7 kit (Ambion, Austin, Tex.), using 1.6 ug of purified tail PCR product to template each 40 uL reaction. A custom ribonucleoside blend was used comprising 3'-0-Me-m7G(5)ppp(5')G ARCA cap analog (New England Biolabs), adenosine triphosphate and guanosine triphosphate (USB, Cleveland, Ohio), 5-methylcytidine triphosphate and pseudouridine triphosphate (TriLink Biotechnologies, San Diego, Calif.). Final nucleotide reaction concentrations were 33.3 mM for the cap analog, 3.8 mM for guanosine triphosphate, and 18.8 mM for the other nucleotides. Reactions were incubated 3-6 hours at 37° C. and DNAse-treated as directed by the manufacturer. RNA was purified using Ambion MEGAclear spin columns, then treated with Antarctic Phosphatase (New England Biolabs) for 30 minutes at 37° C. to remove residual 5'-triphosphates. Treated RNA was re-purified, quantitated by Nanodrop (Thermo Scientific, Waltham, Mass.), and adjusted to 100 ng/uL working concentration by addition of Tris-EDTA (pH 7.0). RNA reprogramming cocktails were prepared by pooling individual 100 ng/uL RNA stocks to produce a 100 ng/uL (total) blend. The KMOS[L]+GFP cocktails were formulated to give equal molarity for each component except for OCT4, which was included at 3× molar concentration. Volumetric ratios used for pooling were as follows: 170:160:420:130:120 [:90] (KLF4:c-MYC:OCT4:SOX2:GFP[:LIN28]).

Cells

The following primary cells were obtained from ATCC (Manassas, Va.): human neonatal epidermal keratinocytes, BJ human neonatal foreskin fibroblasts, MRC-5 human fetal lung fibroblasts, and Detroit 551 human fetal skin fibroblasts. CF cells were obtained with informed consent from a skin biopsy taken from an adult cystic fibrosis patient. The Daley Lab provided dH1f fibroblasts, which were sub-cloned from fibroblasts produced by directed differentiation of the H1-OGN human ES cell line as previously described (Park et al., 2008). BGO1 hES cells were obtained from BresaGen (Athens, Ga.). H1 and H9 hES cells were obtained from WiCell (Madison, Wi).

RNA Transfection

RNA transfections were carried out using RNAiMAX (Invitrogen) or TransIT-mRNA (Mirus B10, Madison, Wis.) cationic lipid delivery vehicles. RNAiMAX was used for RiPS derivations, the RiPS-to-myogenic conversion, and for the multiple cell-type transfection experiment documented in FIGS. 3A-3F. All other transfections were performed with TransIT-mRNA. For RNAiMAX transfections, RNA and reagent were first diluted in Opti-MEM basal media (Invitrogen). 100 ng/uL RNA was diluted 5× and 5 uL of RNAiMAX per microgram of RNA was diluted 10×, then these components were pooled and incubated 15 minutes at room temperature before being dispensed to culture media. For TransIT-mRNA transfections, 100 ng/uL RNA was diluted 10× in Opti-MEM and BOOST reagent was added (2 uL per microgram of RNA), then TransIT-mRNA was added (2 uL per microgram of RNA), and the RNA-lipid complexes were delivered to culture media after a 2-minute incubation at room temperature. RNA transfections were performed in Nutristem xeno-free hES media (Stemgent, Cambridge, Mass.) for RiPS derivations, Dermal Cell Basal Medium plus Keratinocyte Growth Kit (ATCC) for keratinocyte experiments, and Opti-MEM plus 2% FBS for all other experiments described. The B18R interferon inhibitor (eBioscience, San Diego, Calif.) was used as a media supplement at 200 ng/mL.

qRT-PCR of Interferon-Regulated Genes

Transfected and control 6-well cultures were washed with PBS and lysed in situ using 400 uL CellsDirect resuspension buffer/lysis enhancer (Invitrogen) per well, and 20 uL of each lysate was taken forward to a 50 uL reverse transcription reaction using the VILO cDNA synthesis kit (Invitrogen). Completed reactions were purified on QIAquick columns (Qiagen), and analyzed in 20 uL qPCRs, each templated with ~10% of the total cDNA prep. The reactions were performed using SYBR FAST qPCR supermix (KAPA Biosystems) with 250 nM primers and a thermal profile including 35 cycles of (95° C. 3 s; 60° C. 20 s). The qPCR primer sequences used are given Table 5.

TABLE 5

Primers for qRT-PCR analysis of interferon-regulated genes (SEQ ID NOs: 1467-1480, respectively, in order of appearance).

| Transcript | Forward Primer | Reverse Primer |
|---|---|---|
| GAPDH | GAAGGCTGGGGCTCATTT | CAGGAGGCATTGCTGATGAT |
| IFNA | ACCCACAGCCTGGATAACAG | ACTGGTTGCCATCAAACTCC |
| IFNB | CATTACCTGAAGGCCAAGGA | CAGCATCTGCTGGTTGAAGA |
| IFIT1 | AAAAGCCCACATTTGAGGTG | GAAATTCCTGAAACCGACCA |
| OAS1 | CGATCCCAGGAGGTATCAGA | TCCAGTCCTCTTCTGCCTGT |
| PKR | TCGCTGGTATCACTCGTCTG | GATTCTGAAGACCGCCAGAG |
| RIG-I | GTTGTCCCCATGCTGTTCTT | GCAAGTCTTACATGGCAGCA |

Reprogramming to Pluripotency

Gamma-irradiated human neonatal fibroblast feeders (GlobalStem, Rockville, Md.) were seeded at 33,000 cells/cm2. Nutristem media was used during the reprogramming phase of these experiments. Media was replaced daily, four hours after transfection, and supplemented with 100 ng/mL bFGF (Stemgent) and 200 ng/mL B18R before use. Where applied, VPA was added to media at 1 mM final concentration on days 8-15 of reprogramming. Low-oxygen culture experiments were carried out in a NAPCO 8000 WJ incubator (Thermo Scientific) supplied by NF300 compressed nitrogen cylinders (Airgas, Radnor, Pa.). Media were equilibrated at 5% $O_2$ for approximately 4 hours before use. Cultures were passaged using TrypLE Select recombinant protease (Invitrogen). Y27632 ROCK inhibitor (Watanabe et al., 2007) was purchased from Stemgent and included at 10 uM in recipient plates until the next media change, except where otherwise indicated. The daily RNA dose applied in the RiPS derivations was 1200 ng per well (6-well plate format) or 8 ug to a 10-cm dish.

For the RNA vs. retrovirus trial, both arms of the experiment were started with the same number of dH1f cells, and the passaging of the cultures was synchronized. Starting cultures were seeded with 100,000 cells in individual wells of a 6-well plate using fibroblast media (DMEM+10% FBS). The following day (day 1) KMOS RNA transfections were initiated in the RNA plate, and the viral plate was transduced with a KMOS retroviral cocktail (MOI=5 for each virus). All wells were passaged on day 6, using split ratios of 1:6 for the RNA wells and 1:3 for the virus wells. The conditions applied in the RNA arm of the trial were as in the initial RiPS derivation, including the use of Nutristem supplemented with 100 ng/mL bFGF, 5% O2 culture, and human fibroblast feeders. Ambient oxygen tension and other conventional iPS derivation conditions were used in the viral arm, the cells being grown in fibroblast media without feeders until the day 6 split, then being replated onto CF1 MEF feeders (GlobalStem) with a switch to hES media based on Knockout Serum Replacement (Invitrogen) supplemented with 10 ng/mL bFGF.

Culture of RiPS Cell Colonies

Emerging RiPS cell colonies were picked and clonally transferred to MEF-coated 24-well plates (Nunc, Rochester, N.Y.) with standard hES medium containing 5 uM Y27632 (BioMol, Plymouth Meeting, Pa.). The hES media comprised DMEM/F12 supplemented with 20% Knockout Serum Replacement (Invitrogen), 10 ng/mL of bFGF (Gembio, West Sacramento, Calif.), 1× non-essential amino acids (Invitrogen), 0.1 mM β-ME (Sigma), 1 mM L-glutamine (Invitrogen), plus antibiotics. Clones were mechanically passaged once more to MEF-coated 6-well plates (Nunc), and then expanded using enzymatic passaging with collagenase IV (Invitrogen). For RNA and DNA preparation, cells were plated onto hES-qualified Matrigel (BD Biosciences) in mTeSR (Stem Cell Technologies, Vancouver, BC), and further expanded by enzymatic passaging using dispase (Stem Cell Technologies).

Immunostaining of Pluripotency Markers

For fixed-cell imaging, RiPS colonies were mechanically picked and plated onto MEF feeders in black 96-well plates (Matrix Technologies, Maumee, Ohio). Two days post-plating, cells were washed with PBS and fixed in 4% paraformaldehyde for 20 minutes. After 3 PBS washes, cells were treated with 0.2% Triton X (Sigma) in PBS for 30 minutes to allow nuclear permeation. Cells were washed 3× in PBS and blocked in blocking buffer containing 3% BSA (Invitrogen) and 5% donkey serum (Sigma) for 2 hours at room temperature. After three PBS washes, cells were stained in blocking buffer with primary and conjugated antibodies at 4° C. overnight. After washing 3× with PBS, cells were stained with secondary antibodies and 1 ug/mL Hoechst 33342 (Invitrogen) in blocking buffer for 3 hours at 4° C. or for 1 hour at room temperature, protected from light. Cells were washed 3× with PBS before visualization. The following antibodies were used, at 1:100 dilution: TRA-1-60-Alexa Fluor 647, TRA-1-81-Alexa Fluor 488, SSEA-4-Alexa Fluor 647, and SSEA-3-Alexa 488 (BD Biosciences). Primary OCT4 and NANOG antibodies (Abcam, Cambridge, Mass.) were used at 0.5 ug/mL, and an anti-rabbit IgG Alexa Fluor 555 (Invitrogen) was used as the secondary. Images were acquired with a Pathway 435 bioimager (BD Biosciences) using a 10× objective. Live imaging was performed as described previously (Chan et al., 2009). Briefly, wells were stained by adding 1:100-diluted TRA-1-60-Alexa 647 and SSEA-4-Alexa 555 antibodies (BD Biosciences) to culture media. After 1.5 hours, Hoechst 33342 was added at a final concentration of 0.25 ug/mL, and wells were incubated for an additional 30 minutes. Wells were washed 3× with DMEM/F12 base media lacking phenol red, and imaged in hES media lacking phenol red. Images were acquired with a Pathway 435 bioimager using 4× and 10× objectives. Post-acquisition image processing and analysis was performed using Adobe Photoshop for pseudocoloring and ImageJ (http://rsbweb.nih.gov/ij) for flat-field correction, background subtraction, and colony quantitation.

For pluripotency factor time course experiments, transfected human epidermal keratinocytes were trypsinized, washed with PBS, and fixed in 4% paraformaldehyde for 10 minutes. Fixed cells were washed with 0.1M glycine, then blocked and permeabilized in PBS/0.5% saponin/1% goat serum (Rockland Immunochemicals, Gilbertsville, Pa.) for 20 minutes. Cells were incubated for 1 hour at room temperature with 1:100 diluted primary antibodies for KLF4, OCT4, SOX2 (Stemgent), washed, then for 45 minutes at room temperature with 1:200-diluted DyLight 488-labeled secondary antibodies (goat anti-mouse IgG+IgM and goat anti-rabbit IgG). Cells suspended in PBS were analyzed by flow cytometry.

Gene Expression Analysis

RNA was isolated using the RNeasy kit (Qiagen) according to the manufacturer's instructions. First-strand cDNA was primed with oligo(dT) primers and qPCR was performed with primer sets as described previously (Park et al., 2008), using Brilliant SYBR Green master mix (Stratagene, La Jolla, Calif.). For the microarray analysis, RNA probes were prepared and hybridized to Human Genome U133 Plus 2.0 oligonucleotide microarrays (Affymetrix, Santa Clara, Calif.) per the manufacturer's instructions. Arrays were processed by the Coriell Institute Genotyping and Microarray Center (Camden, N.J.). Microarray data will be uploaded to the GEO database. Gene expression levels were normalized with the Robust Multichip Average (RMA) algorithm. Unsupervised hierarchical clustering was performed using the Euclidean distance with average linkage method. The similarity metric for comparison between different cell lines is indicated on the height of cluster dendrogram.

Bisulfite Sequencing

DNA was extracted using the DNeasy Blood and Tissue kit (Qiagen) according to the manufacturer's protocol. Bisulfite treatment of genomic DNA was carried out using EZ DNA Methylation™ Kit (Zymo Research, Orange, Calif.) according to the manufacturer's protocol. For pyrosequencing analysis, the bisulfite treated DNA was first amplified by HotStar Taq Polymerase (Qiagen) for 45 cycles of (95° C. 30 s; 53° C. 30 s; 72° C. 30 s). The analysis was performed by EpigenDx using the PSQ™96HS system according to standard procedures using primers that were developed by EpigenDx for the CpG sites at positions (−50) to (+96) from the start codon of the OCT4 gene.

Tri-Lineage Differentiation

Embryoid body (EB) hematopoietic differentiation was performed as previously described (Chadwick et al., 2003). Briefly, RiPS cells and hES cell controls were passaged with collagenase IV and transferred (3:1) in differentiation medium to 6-well low-attachment plates and placed on a shaker in a 37° C. incubator overnight. Starting the next day, media was supplemented with the following hematopoietic cytokines: 10 ng/mL of interleukin-3 (R&D Systems, Minneapolis, Minn.) and interleukin-6 (R&D), 50 ng/mL of G-CSF (Amgen, Thousand Oaks, Calif.) and BMP-4 (R&D), and 300 ng/mL of SCF (Amgen) and Flt-3 (R&D). Media was changed every 3 days. On day 14 of differentiation, EBs were dissociated with collagenase B (Roche, Indianapolis, Ind.). 2×104 differentiated cells were plated into methylcellulose H4434 (Stem Cell Technologies) and transferred using a blunt needle onto 35 mm dishes (Stem Cell Technologies) in triplicate and incubated at 37° C. and 5° C. O2 for 14 days. Colony Forming Units (CFUs) were scored based on morphological characteristics.

For neuronal differentiation, cells were differentiated at 70% confluency as a monolayer in neuronal differentiation medium (DMEM/F12, Glutamax 1%, B27-Supplement 1%, N2-Supplement 2%, P/S1% and noggin 20 ng/ml). After 7 days neuronal structures were visible. For endoderm differentiation (AFP stain), cells were differentiated as a monolayer in endoderm differentiation medium (DMEM, B27(-RA) and 100 ng/ml activin-a) for 7 days, then switched to growth medium (DMEM, 10% FBS, 1% P/S) and continued differentiation for 7 days. Primary antibodies used in immunostaining were as follows: Anti-β-Tubulin III (Tuj1) rabbit anti-human (Sigma, St. Louis, Mo.), 1:500; AFP (h-140) rabbit polyclonal IgG, (Santa Cruz Biotechnology, Santa Cruz, Calif.), 1:100 dilution. All secondary antibodies were conjugated to Alexa Fluor 488, Alexa Fluor 594 and raised in donkey.

For cardiomyocyte differentiation, colonies were digested at 70% confluency using dispase and placed in suspension culture for embryoid body (EB) formation in differentiation medium (DMEM, 15% FBS, 100 uM ascorbic acid). After 11 days, EBs were plated to adherent conditions using gelatin and the same medium. Beating cardiomyocytes were observed 3 days after replating.

For the teratoma assay, $2.5 \times 10^6$ cells were harvested, spun down, and all excess media was removed. In a 20-week old female SCID mouse, the capsule of the right kidney was gently elevated, and one droplet of concentrated cells was inserted under the capsule. At week 6, when adequate tumor size was observed, the tumor was harvested, fixed in 4% PFA, run through an ethanol gradient, and stored in 70% ethanol. Specimens were sectioned and H&E staining. Slides were imaged with a Leica light microscope.

Myogenic Differentiation of RiPS Cells

Validated RiPS cells were plated into wells coated with 0.1% gelatin (Millipore, Billerica, Mass.), and cultured in DMEM+10% FBS for 4 weeks with passaging every 4-6 days using trypsin. The culture media was switched to Opti-MEM+2% FBS, and the cells were transfected with modified RNA encoding either murine MYOD or GFP the following day, and for the following two days. Media was supplemented with B18R, and replaced 4 hours after each transfection. After the third and final transfection, the media was switched to DMEM+3% horse serum, and cultures were incubated for a further 3 days. Cells were then fixed in 4% PFA and immunostained as previously described (Shea et al., 2010). The percentage of myogenin-positive nuclei/total nuclei and nuclei/MyHC-positive myotubes was quantified, with a minimum of 500 nuclei counted per condition.

Thus far, the reprogramming of differentiated cells to pluripotency shows great utility as a tool for studying normal cellular development, while also having the potential for generating patient-specific induced pluripotent stem (iPS) cells that can be used to model disease, or to generate clinically useful cell types for autologous therapies aimed at repairing deficits arising from injury, illness, and aging. Induction of pluripotency was originally achieved by Yamanaka and colleagues by enforced expression of four transcription factors, KLF4, c-MYC, OCT4, and SOX2 (KMOS) using retroviral vectors (Takahashi et al., 2007; Takahashi and Yamanaka, 2006).

A formidable obstacle to therapeutic use of iPS cells has been presented by the requirement for viral integration into the genome. The search for ways to induce pluripotency without incurring genetic change has become the focus of intense research effort. Towards this end, attempts to derive iPS cells using excisable lentiviral and transposon vectors, or through repeated application of transient plasmid, episomal, and adenovirus vectors have been made (Chang et al., 2009; Kaji et al., 2009; Okita et al., 2008; Stadtfeld et al., 2008; Woltjen et al., 2009; Yu et al., 2009). Human iPS cells have also been derived using two DNA-free methods: serial protein transduction with recombinant proteins incorporating cell-penetrating peptide moieties (Kim et al., 2009; Zhou et al., 2009), and transgene delivery using the Sendai virus, which has a completely RNA-based reproductive cycle (Fusaki et al., 2009).

Considerable limitations accompany the non-integrative iPS derivation strategies devised thus far. For example, DNA transfection-based methodologies still entail risk of genomic recombination or insertional mutagenesis, even though they are supposedly safer than viral-based delivery methods. In the protein-based strategies thus far derived, the recombinant proteins used are difficult and challenging to generate and purify in the quantities required, and result in even lower efficiencies of pluripotent stem cell generation that conventional viral-based methods (Zhou et al., 2009). Use of Sendai virus requires stringent steps to purge reprogrammed cells of replicating virus, and the sensitivity of the viral RNA replicase to transgene sequence content can further limit the generality of this reprogramming vehicle (Fusaki et al., 2009). Importantly, the methods discussed that rely on repeat administration of transient vectors, whether DNA or protein-based, have shown very low reprogramming and iPS derivation efficiencies (Jia et al., 2010; Kim et al., 2009; Okita et al., 2008; Stadtfeld et al., 2008; Yu et al., 2009; Zhou et al., 2009), presumably due, without wishing to be bound or limited by theory, to weak or inconstant expression of reprogramming factors.

As demonstrated herein, the inventors have discovered and shown that repeated administration of synthetic, modified messenger RNAs that incorporate novel modifications designed to bypass innate cellular anti-viral responses can reprogram differentiated human cells to pluripotency with conversion efficiencies and kinetics vastly and unexpectedly superior to established protein- and viral-based protocols. Accordingly, described herein are methods and compositions demonstrating that this non-mutagenic, efficient, and highly controllable technology is applicable to a wide range of cellular engineering tasks involving altering cellular developmental potentials, such as the reprogramming of differentiated cells, and the differentiation of reprogrammed cells to a differentiated cell type, such as RNA-iPS (RiPS)-derived fibroblasts to terminally differentiated myogenic cells.

Development of Synthetic, Modified RNAs for Directing Cell Fate mRNA was manufactured using in vitro transcription (IVT) reactions templated by PCR amplicons (FIG. 1). To promote efficient translation and boost RNA half-life in the cytoplasm, a 5' guanine cap was incorporated by inclusion of a synthetic cap analog in the IVT reactions (Yisraeli et al., 1989). Within the IVT templates described herein, the open reading frame (ORF) of the gene of interest is flanked by a 5' untranslated region (UTR) containing a strong Kozak translational initiation signal, and an alpha-globin 3' UTR terminating with an oligo(dT) sequence for templated addition of a polyA tail.

Cytosolic delivery of mRNA into mammalian cells can be achieved using electroporation or by complexing the RNA with a cationic vehicle to facilitate uptake by endocytosis (Audouy and Hoekstra, 2001; Elango et al., 2005; Holtkamp et al., 2006; Van den Bosch et al., 2006; Van Tendeloo et al., 2001). The latter approach was utilized by the inventors as it would allow for repeated transfection to sustain ectopic protein expression over the days to weeks required for cellular reprogramming. In experiments in which synthetic RNA encoding GFP was transfected into murine embryonic fibroblasts and human epidermal keratinocytes, high, dose-dependent cytotoxicity was noted, which was not attributable to the cationic vehicle, and which was exacerbated on repeated transfections. These experiments demonstrated a serious impediment to achieving sustained protein expression by repeated mRNA transfection.

It is has been reported that exogenous single-stranded RNA (ssRNA) activates antiviral defenses in mammalian cells through interferon and NF-κB dependent pathways (Diebold et al., 2004; Hornung et al., 2006; Kawai and Akira, 2007; Pichlmair et al., 2006; Uematsu and Akira, 2007). In order to increase the sustainability of RNA-mediated protein expression, approaches were sought to reduce the immunogenic profile of the synthetic RNA. The co-transcriptional capping technique yields a significant fraction of uncapped IVT product bearing 5' triphosphates, which has been reported to trigger the ssRNA sensor RIG-I (Hornung et al., 2006; Pichlmair et al., 2006), and have also been reported to activate PKR, a global repressor of cellular protein translation (Nallagatla and Bevilacqua, 2008). However, treatment of the synthesized RNA with a phosphatase only resulted in modest reductions in the observed cytotoxicity upon repeated transfections.

Eukaryotic mRNA is extensively modified in vivo, and the presence of modified nucleobases has been shown to reduce signaling by RIG-I and PKR, as well as by the less widely expressed but inducible endosomal ssRNA sensors TLR7 and TLR8 (Kariko et al., 2005; Kariko et al., 2008; Kariko and Weissman, 2007; Nallagatla and Bevilacqua, 2008; Nallagatla et al., 2008; Uzri and Gehrke, 2009). In an attempt to further reduce innate immune responses to transfected RNA, mRNAs were synthesized incorporating modified ribonucleoside bases. Complete substitution of either 5-methylcytidine (5mC) for cytidine or pseudouridine (psi) for uridine in GFP-encoding transcripts markedly improved viability and increased ectopic protein expression.

Figures 2A, 2B, 2C, 2D:
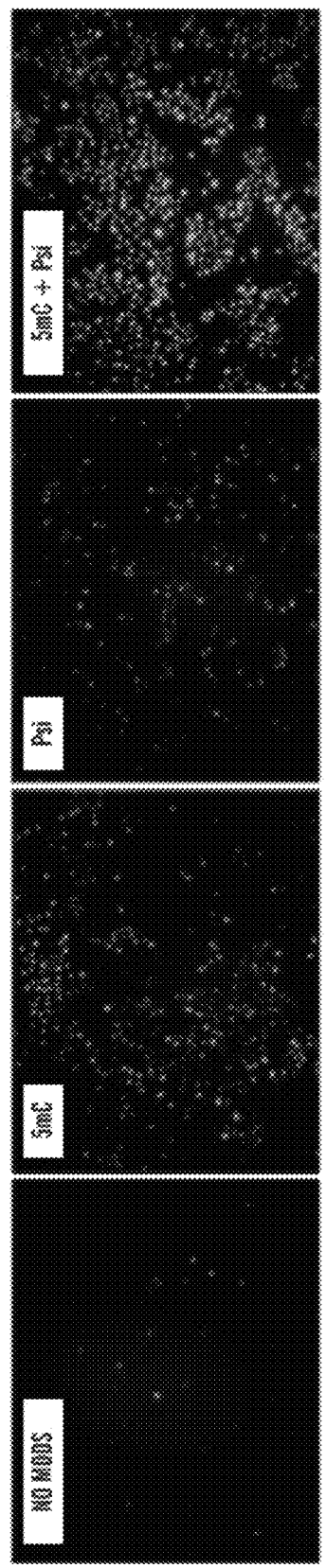
Figure 2E:
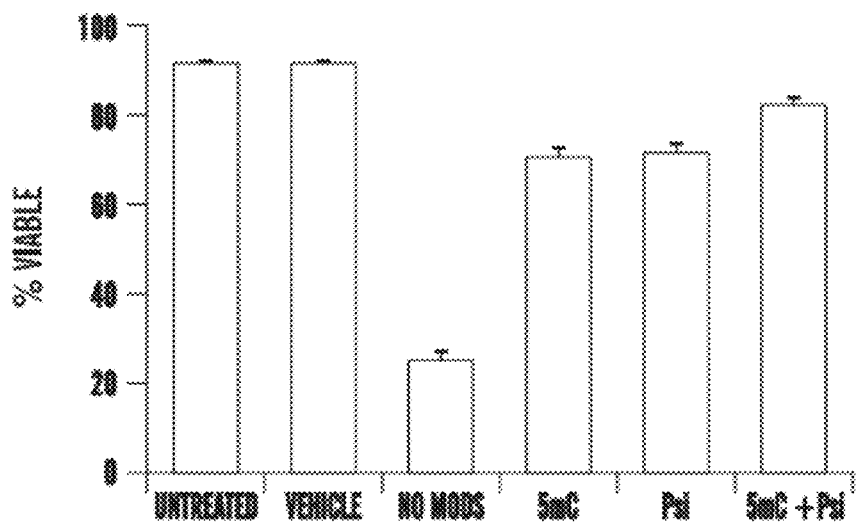
FIG. 2E shows percent viability and FIG. 2L depicts mean fluorescence intensity of the cells shown in FIGS. 2A-2D as measured by flow cytometry.
Figure 2F:
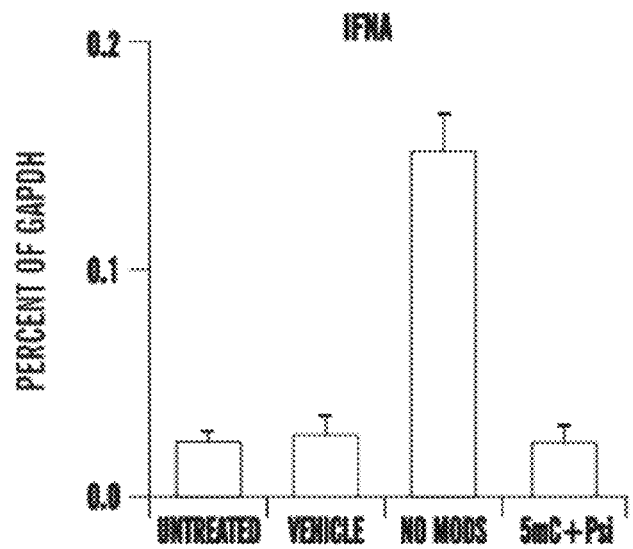
FIGS. 2F-2K demonstrate quantitative RT-PCR data showing expression of six interferon-regulated genes in BJ fibroblasts 24 hours after transfection with unmodified (No Mods), or synthetic, modified (5mC+Psi) RNA encoding GFP (1200 ng/well), and vehicle and untransfected controls.
Figure 2G:
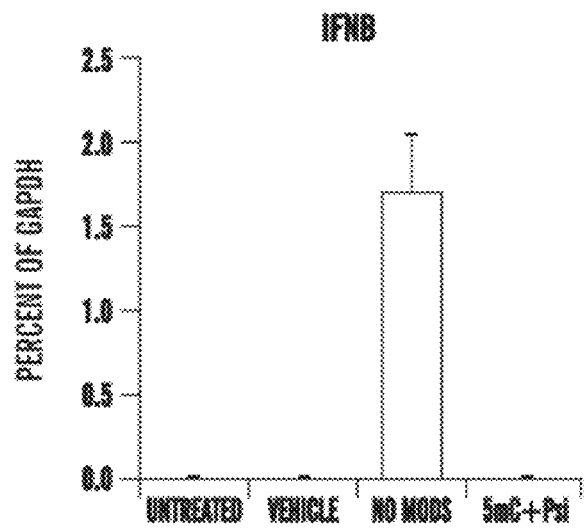
Figure 2H:
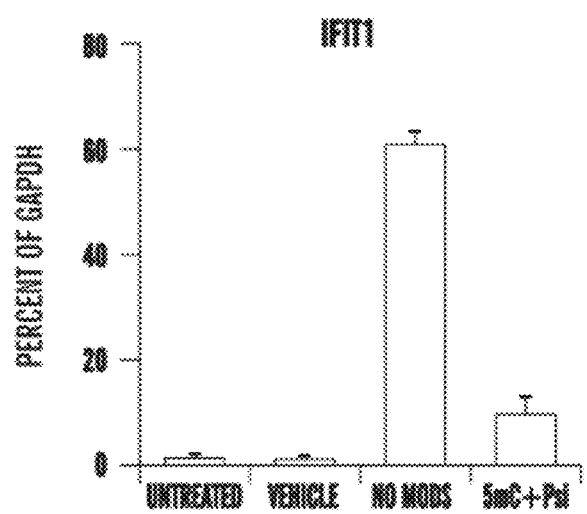
Figure 2I:
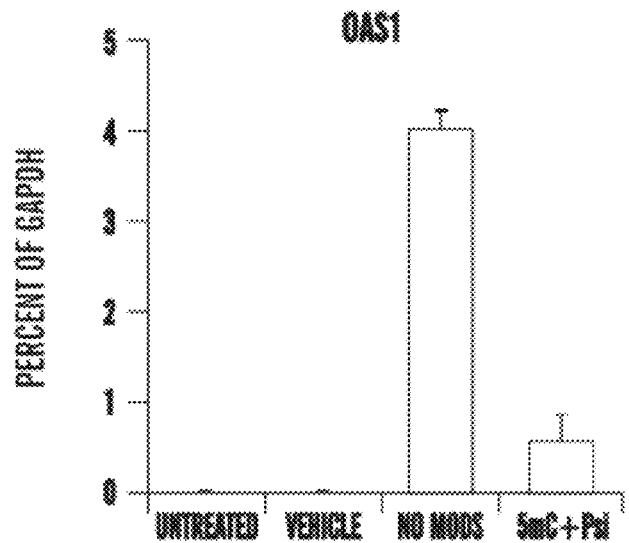
Figure 2J:
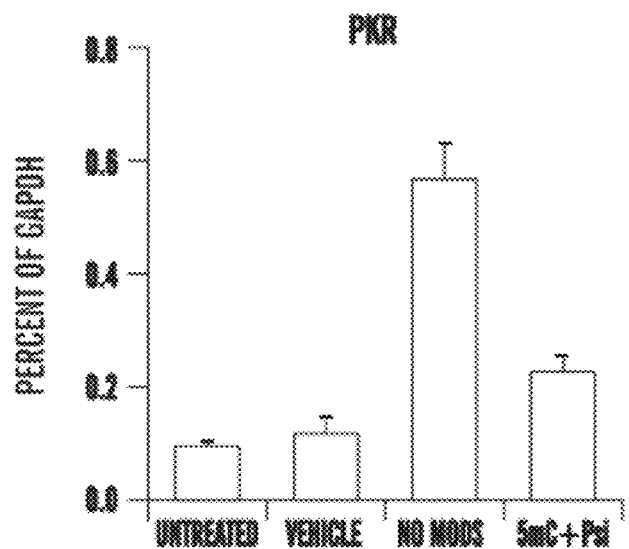
Figure 2K:
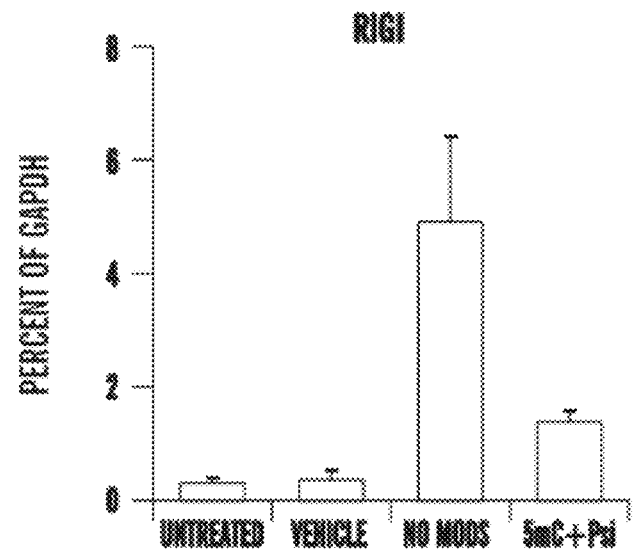
Figure 2L:
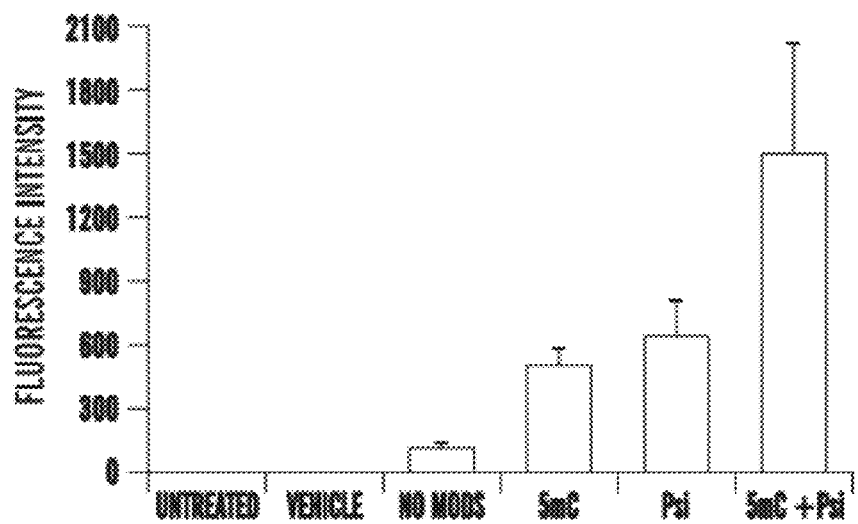
Figure 2M:
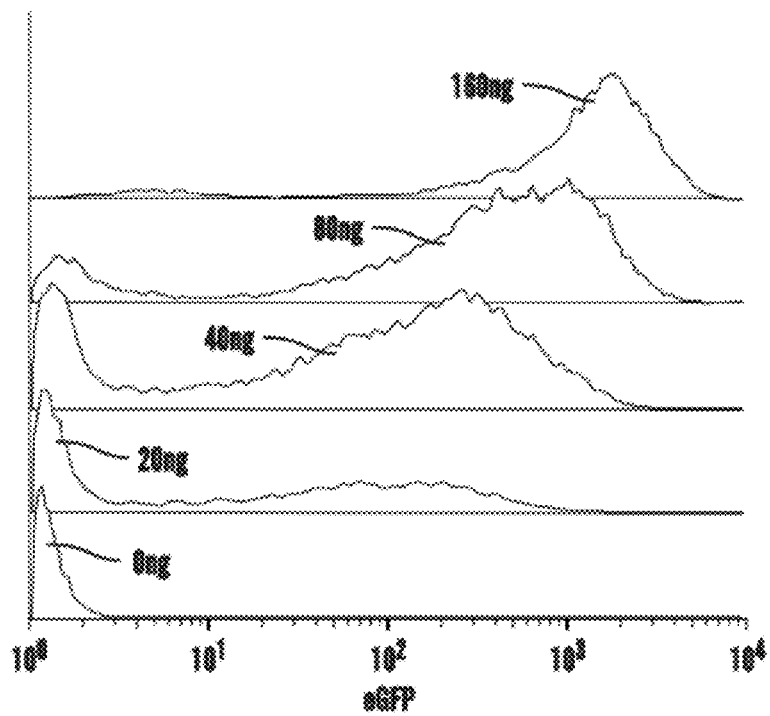
FIG. 2M depicts flow cytometry histograms showing GFP expression in keratinocytes transfected with 0-160 ng of modified RNA, 24 hours post transfection.

However, the most significant improvements in viability and protein expression were observed when both 5-methylcytidine and pseudouridine were used together (FIGS. 2A-2E). It was discovered that these modifications dramatically attenuated interferon signaling as revealed by qRT-PCR for a panel of interferon response genes, although residual upregulation of some interferon targets was still detected (FIGS. 2F-2K). Innate cellular anti-viral defenses can self-prime through a positive-feedback loop involving autocrine and paracrine signaling by Type I interferons (Randall and Goodbourn, 2008). It was found that media supplementation with a recombinant version of B18R protein, a Vaccinia virus decoy receptor for Type I interferons (Symons et al., 1995), further increased cellular viability following RNA transfection, especially in some cell types. It was discovered that synthesis of RNA with a combination of both modified 5-methylcytidine and pseudouridine ribonucleotides and phosphatase treatment (herein termed "synthetic, modified RNAs"), combined with media supplementation with the interferon inhibitor B18R allowed high, dose-dependent levels of protein expression (FIG. 2L).

Figure 2N:
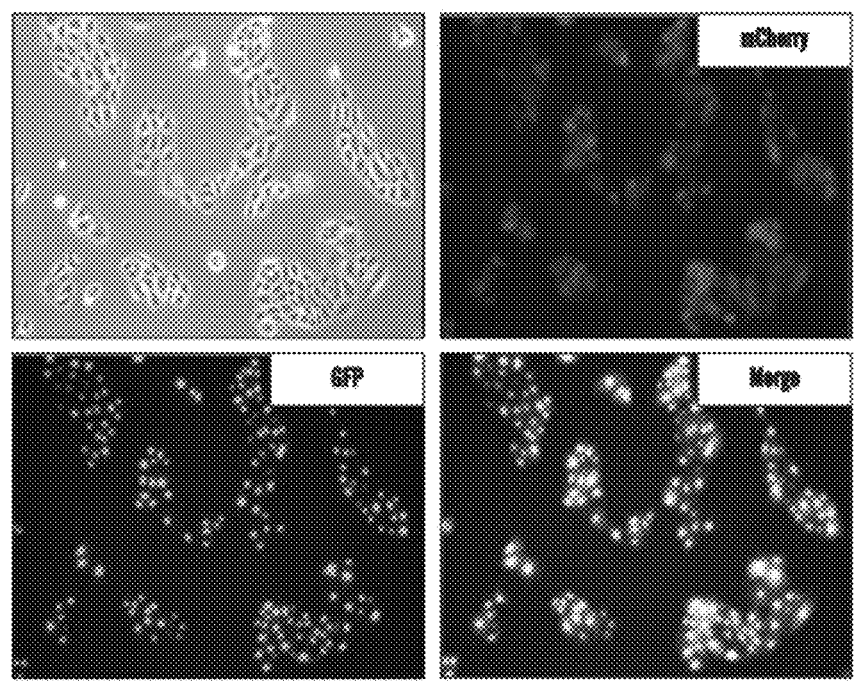
FIG. 2N shows microscopy images of keratinocytes co-transfected with synthetic, modified RNAs encoding GFP with a nuclear localization signal, and cytosolic mCherry proteins.
Figure 20:
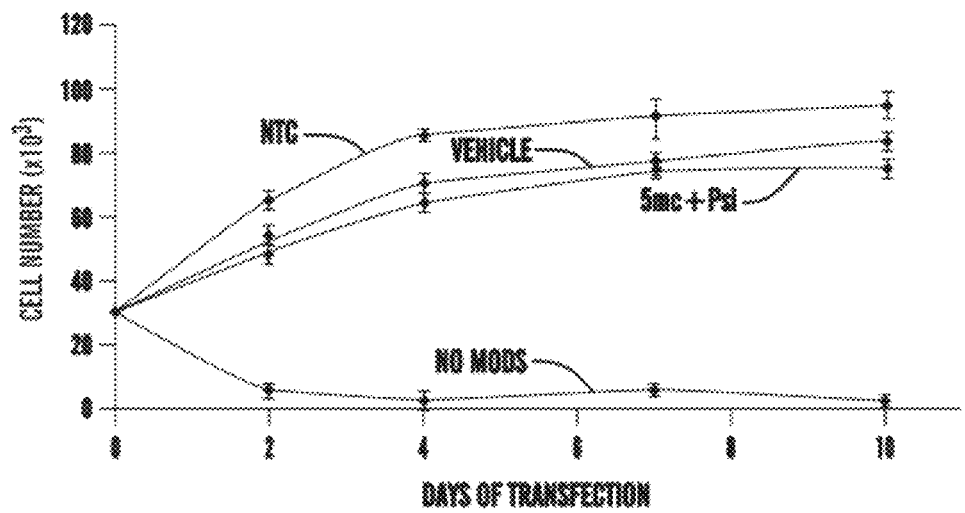
Figure 3A:
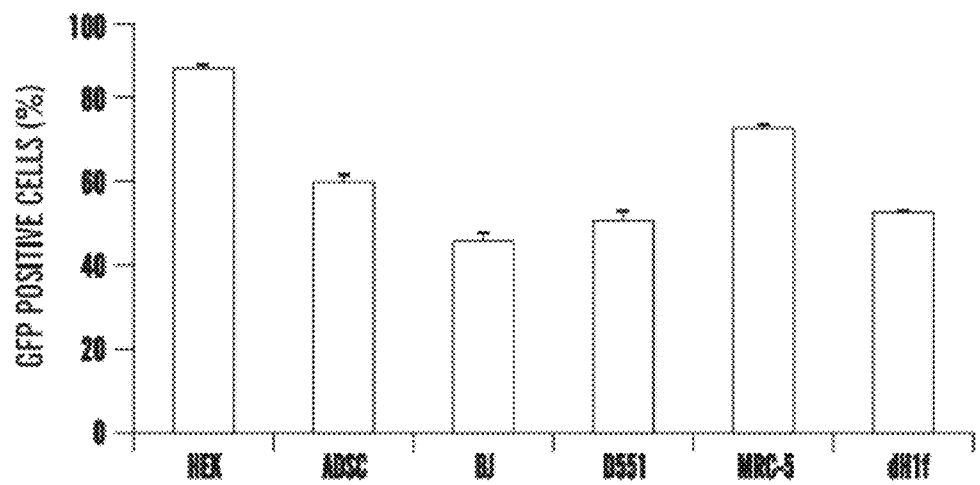

It was discovered that transfection of synthetic, modified RNA encoding GFP into six different human cell types resulted in highly penetrant expression (50-90% positive cells), and demonstrated the applicability of these novel methods and compositions to diverse cell types (FIG. 3A). Simultaneous delivery of synthetic, modified RNAs encoding cytosolic-localized red, and nuclear-localized green fluorescent proteins into keratinocytes revealed that generalized co-expression of multiple proteins could be achieved in mammalian cells, and that the resulting proteins were correctly localized to the cytosol and nucleus, respectively (FIG. 2N).

Figure 3B:
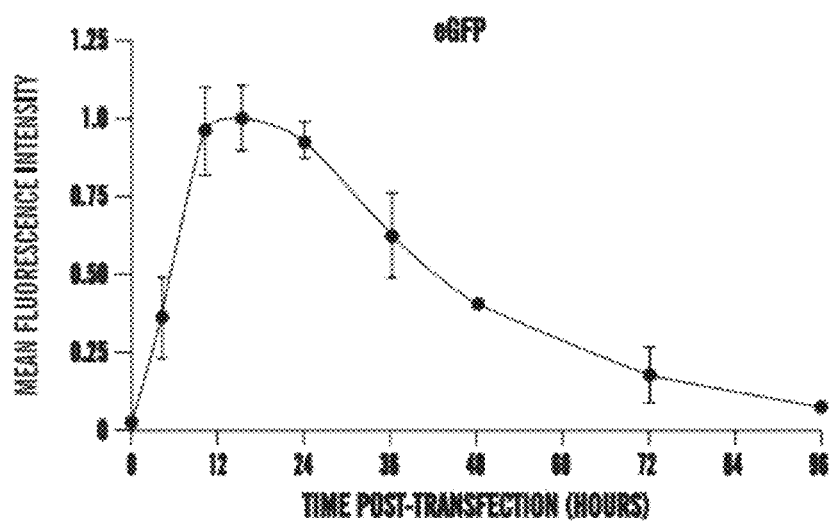
Figure 3C:
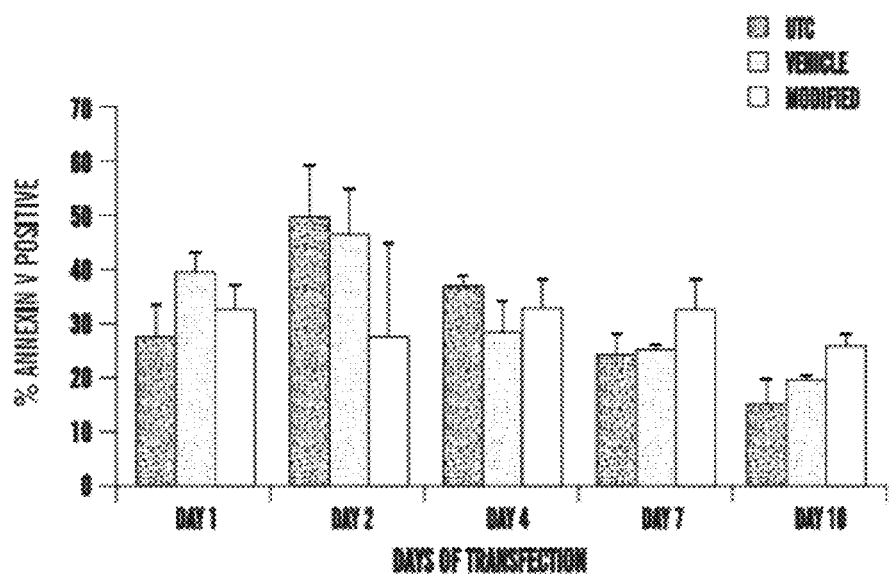
Figure 3D:
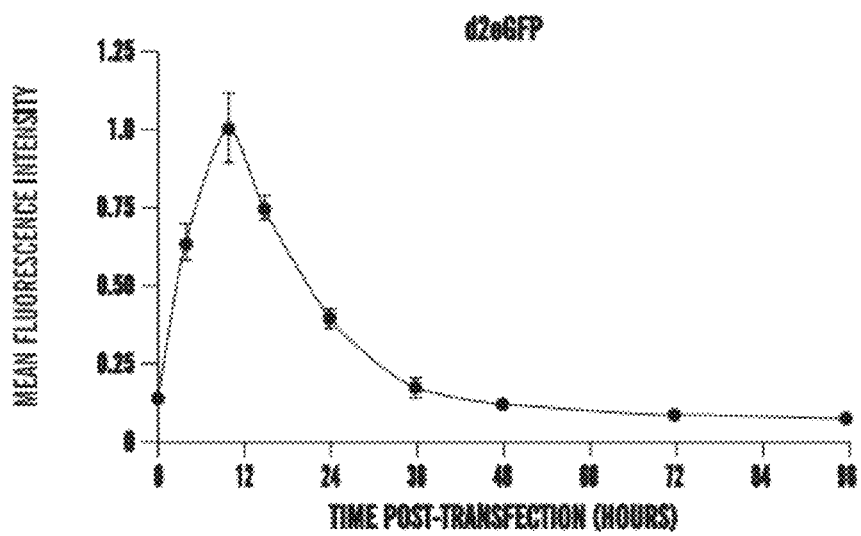
Figure 3E:
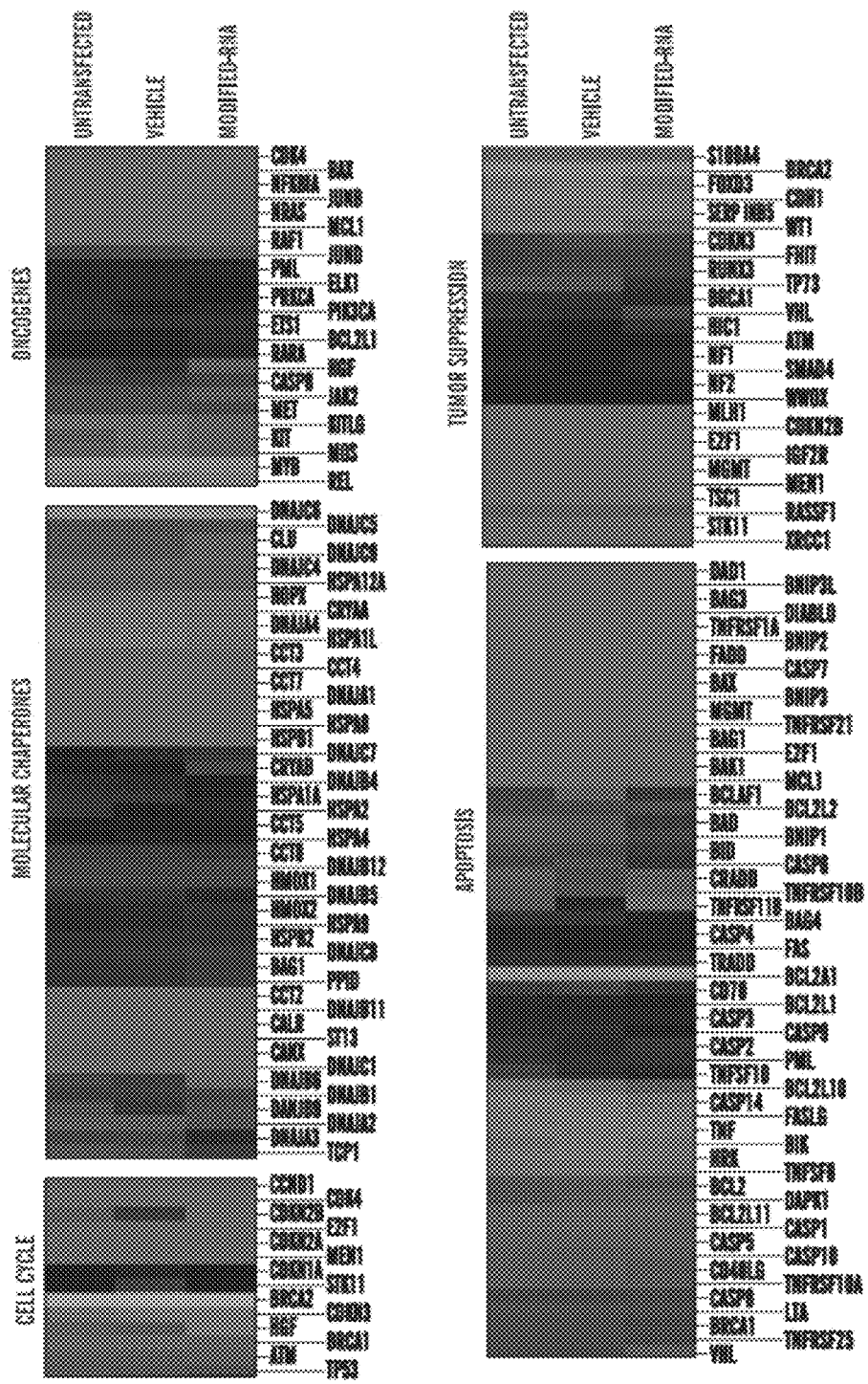
Figure 3E:
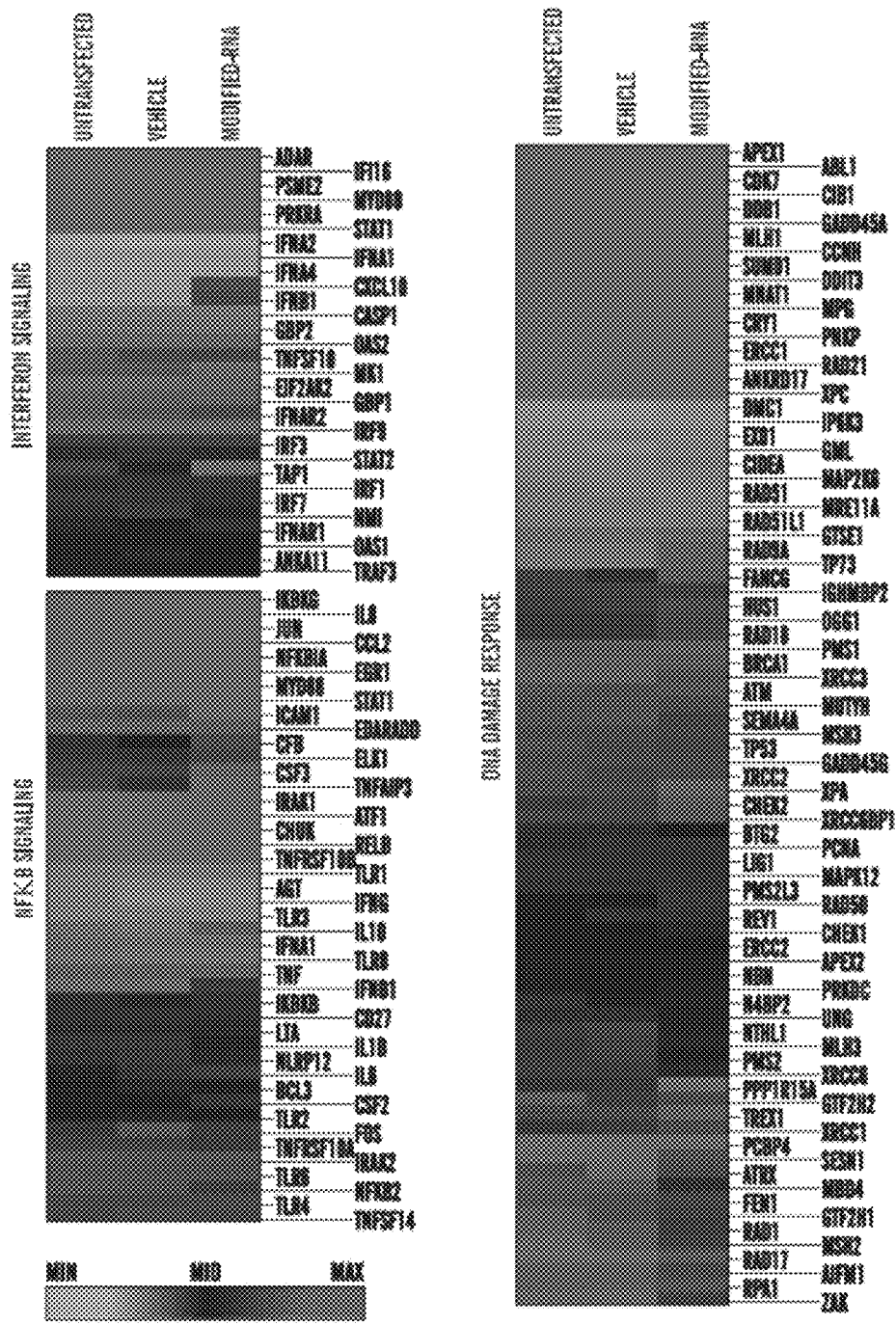

Ectopic protein expression after RNA transfection is transient owing to RNA and protein degradation and the diluting effect of cell division. To establish the kinetics and persistence of protein expression, synthetic, modified RNA encoding GFP variants designed for high and low protein stability (Li et al., 1998) were synthesized and transfected into keratinocytes. Time-course analysis by flow cytometry showed that protein expression persisted for several days for the high-stability variant, but peaked within 12 hours and decayed rapidly thereafter for the destabilized GFP (FIGS. 3B and 3D). These results indicated that a repetitive transfection regimen would be necessary in order to sustain high levels of ectopic expression for short-lived proteins over an extended time course.

To assess this and further address the impact of repeated RNA transfection on cell growth and viability, BJ fibroblasts were transfected daily for 10 days with either unmodified, or synthetic, modified RNAs encoding GFP. It was discovered that daily transfection with synthetic, modified RNA permitted sustained protein expression without substantially compromising the viability of the culture beyond a modest reduction in growth kinetics that was attributable to the transfection reagent vehicle (FIGS. 2O and 3C). Microarray analysis established that prolonged daily transfection with synthetic, modified RNA did not significantly alter the molecular profile of the transfected cells (FIG. 3E), although a modest upregulation of a number of interferon response genes was noted, consistent with the fact that the modifications described herein did not completely abrogate interferon signaling (FIGS. 2F-2K, FIG. 3F). In complete contrast, repeated transfections with unmodified RNA severely compromised the growth and viability of the culture through, in part, elicitation of a massive interferon response (FIGS. 2F-2K), demonstrating that the use of unmodified RNA is not a viable strategy for sustaining long-term polypeptide expression in cells (FIG. 2O).

Figure 2P:
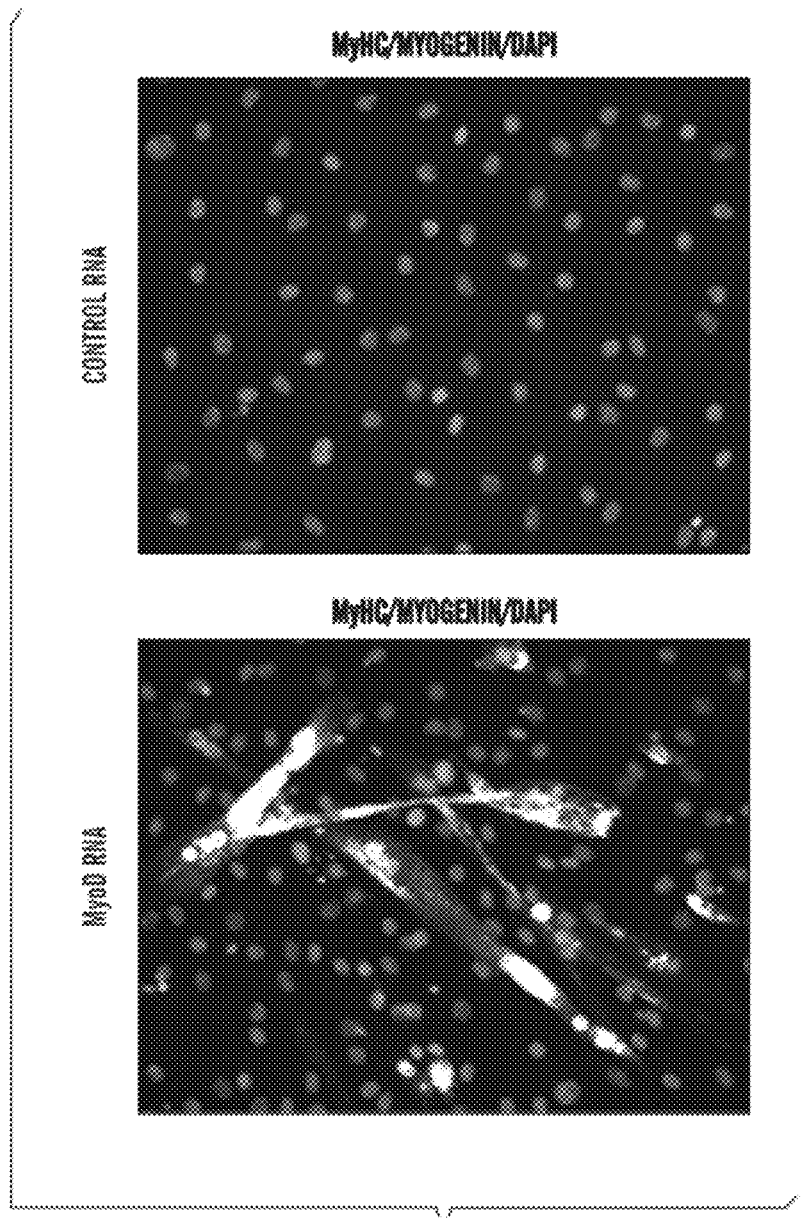
FIG. 2P shows immunostaining for the muscle-specific proteins myogenin and myosin heavy chain (MyHC) in murine C3H/10T1/2 cell cultures 3 days after 3 consecutive daily transfections with a synthetic, modified RNA encoding MYOD.
Figure 2Q:
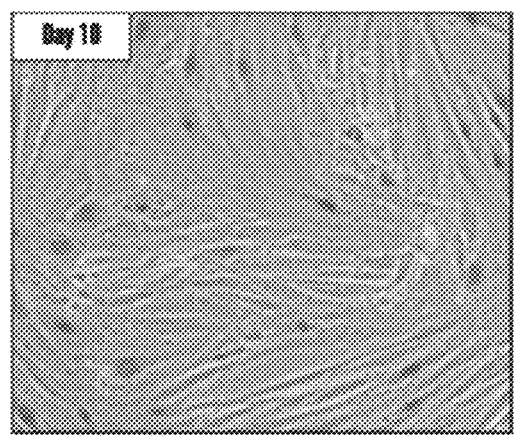
Figure 2R:
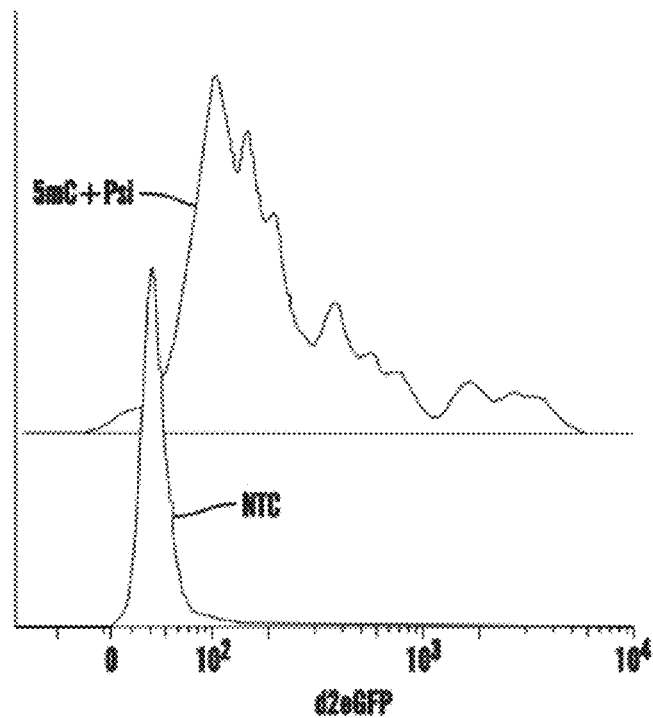

To determine if modified RNAs could be used to directly alter cell fate, synthetic, modified RNA was synthesized encoding the myogenic transcription factor MYOD (Davis et al., 1987) and transfected into murine C3H10T1/2 cells over the course of 3 days, followed by continued culturing in a low serum media for an additional 3 days. The emergence of large, multi-nucleated myotubes that stained positive for the myogenic markers myogenin and myosin heavy chain (MyHC) provided proof that transfection with synthetic, modified RNAs could be utilized to efficiently direct cell fate (FIG. 2P).

Generation of Induced Pluripotent Stem Cells Using Modified RNAs

Figure 4A:
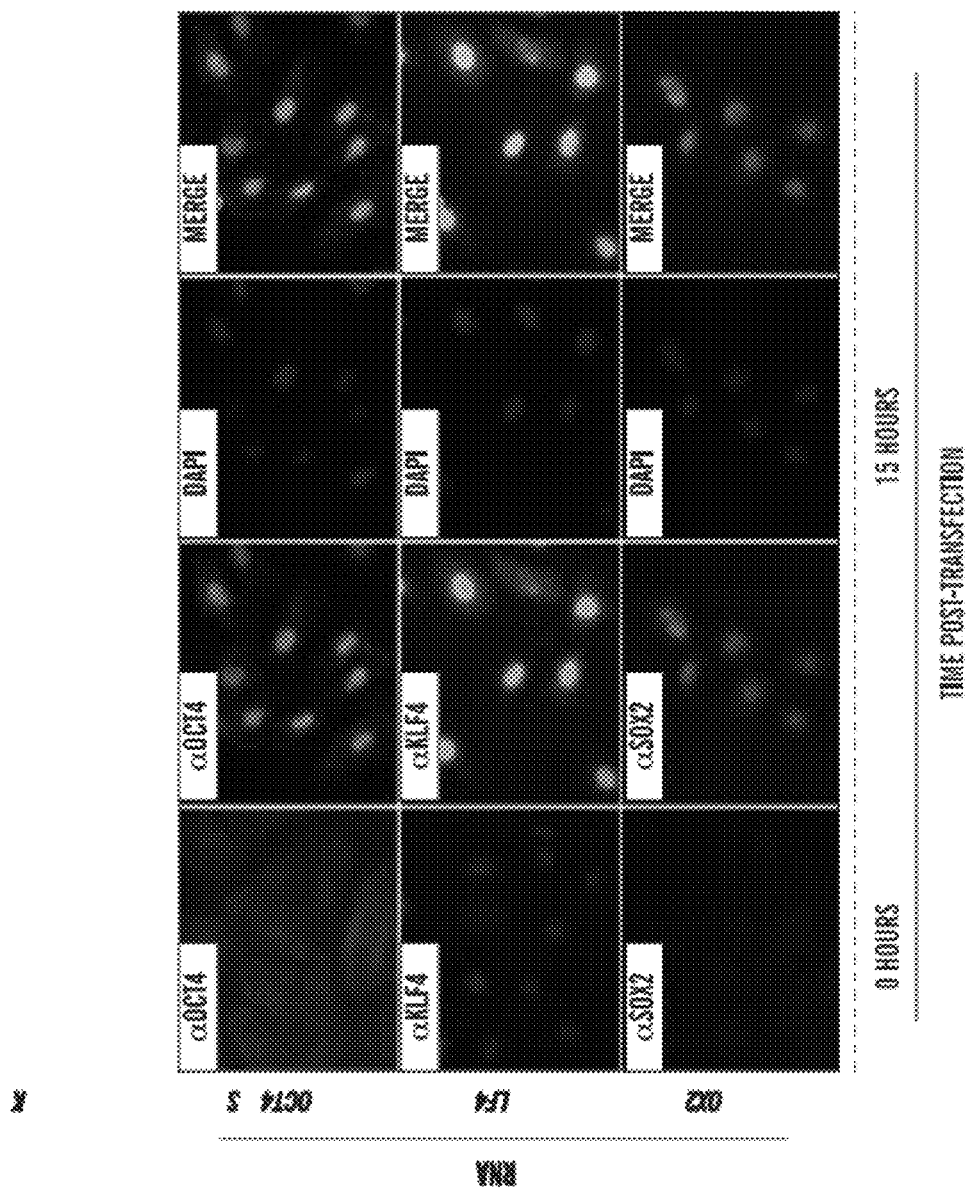
FIGS. 4A-4F demonstrate generation of RNA-induced pluripotent stem cells (RiPS) using the synthetic, modified RNAs described herein.
Figure 4B:
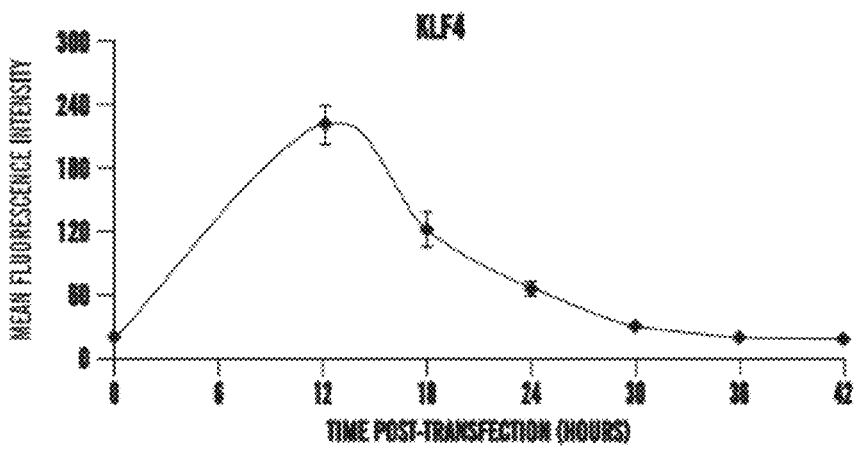
Figure 4C:
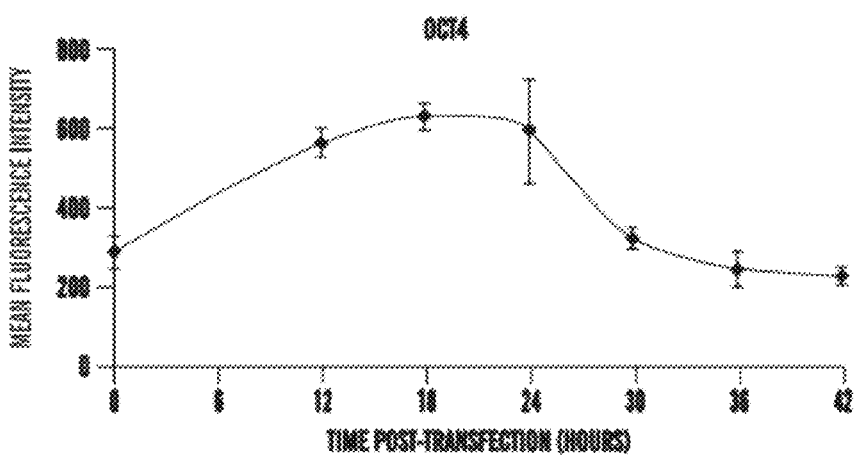
Figure 4D:
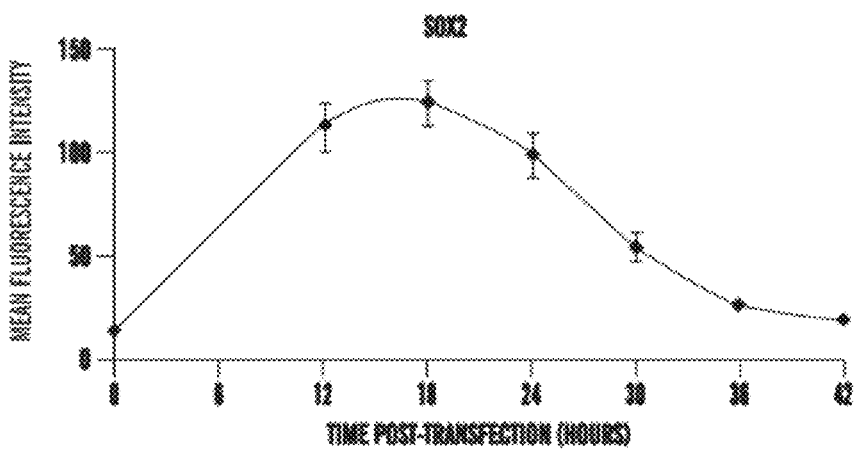
Figure 4E:
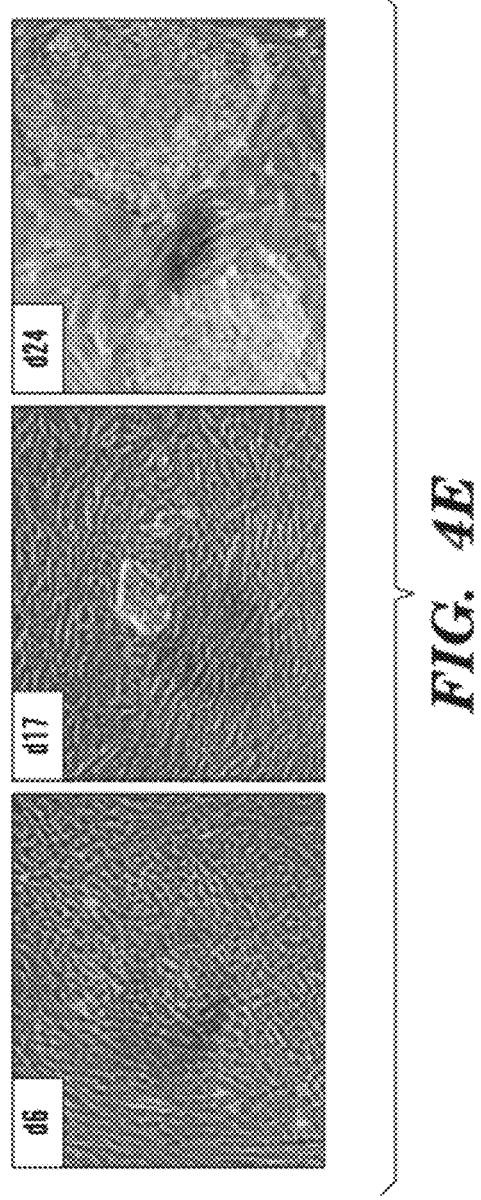

The determination of whether induced pluripotent stem cells (iPS) could be derived using synthetic, modified RNAs was next attempted. To this end, synthetic, modified RNAs encoding the four canonical Yamanaka factors, KLF4 (K), c-MYC (M), OCT4 (O), and SOX2 (S), were synthesized, transfected into cells. It was discovered that the synthetic, modified RNAs encoding transcription factors yielded robust protein expression that localized to the nucleus (FIG. 4A). Time-course analysis monitored by flow cytometry yielded expression kinetics and stability similar to destabilized GFP (FIGS. 3B and 3D), demonstrating rapid turnover of these transcription factors (FIGS. 4B-4D). From this, it was concluded that daily transfections would be required to maintain sufficient expression of the Yamanaka factors during long-term, multi-factor reprogramming regimens.

Figure 5A:
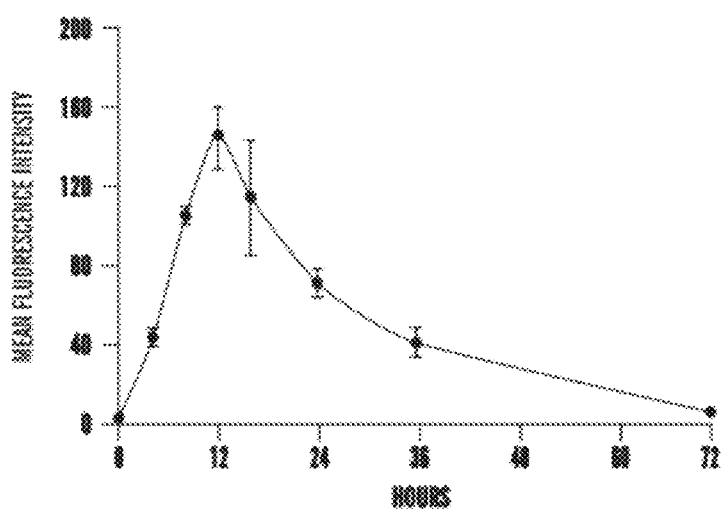
FIGS. 5A-5C demonstrate iPS-derivation from five human cell types.
Figure 5B:
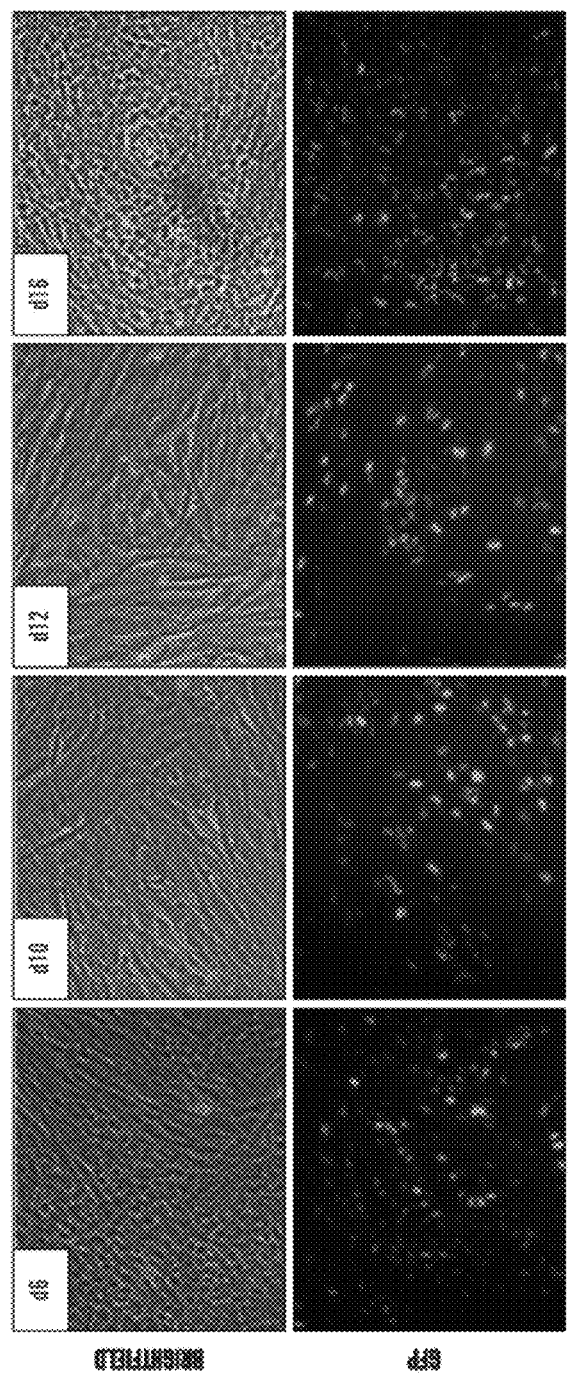
Figure 5C:
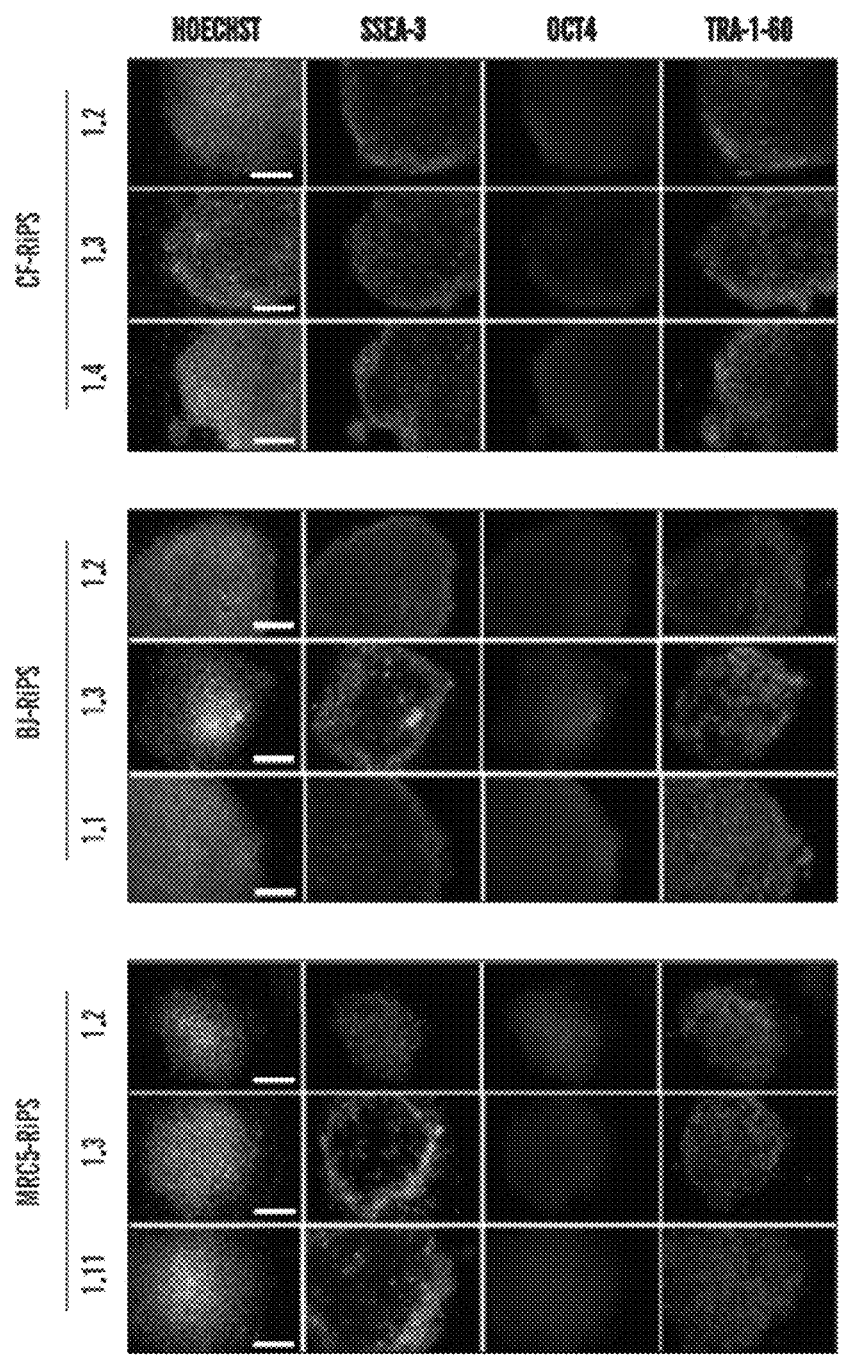
Figure 5C:
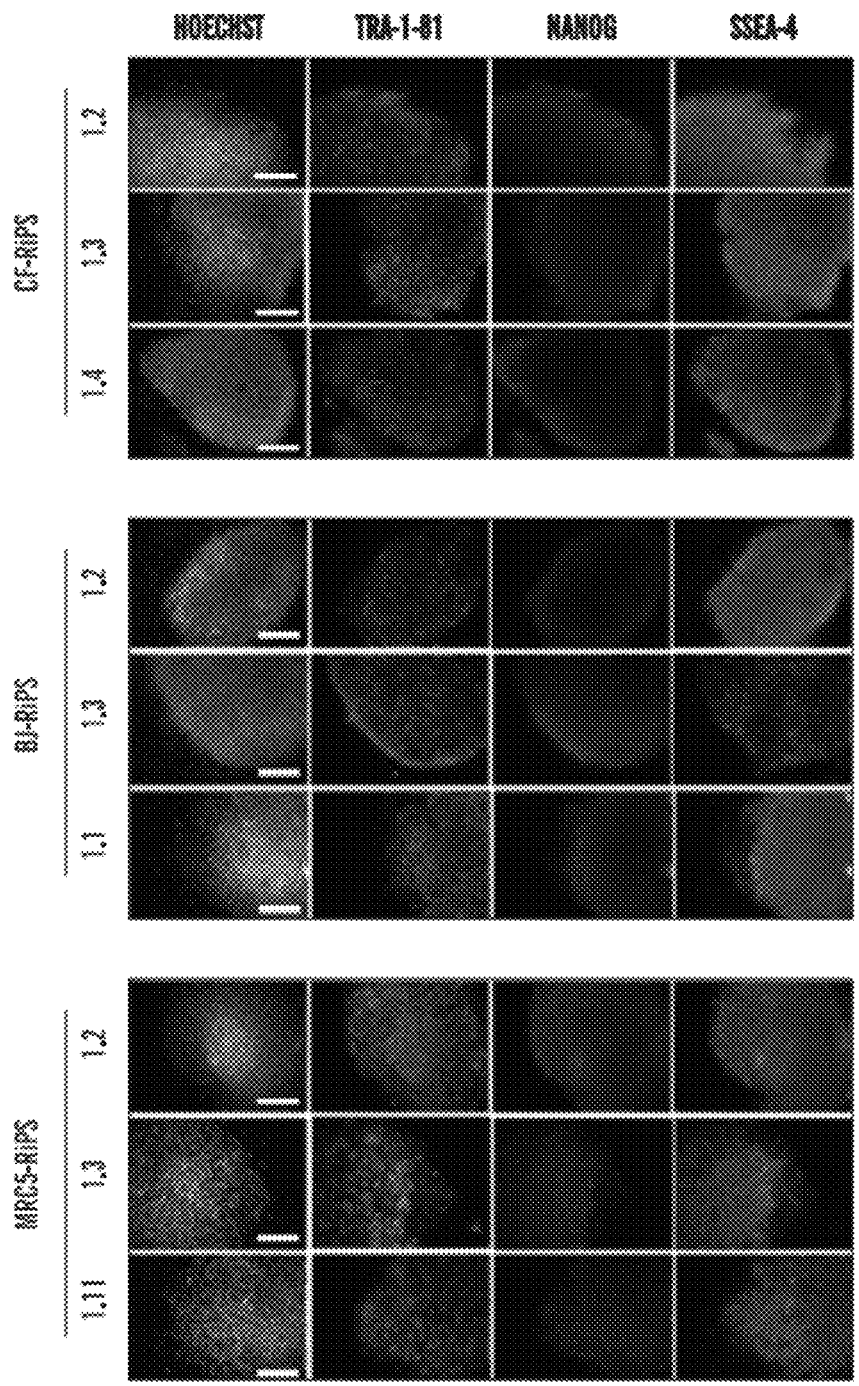
Figure 5C:
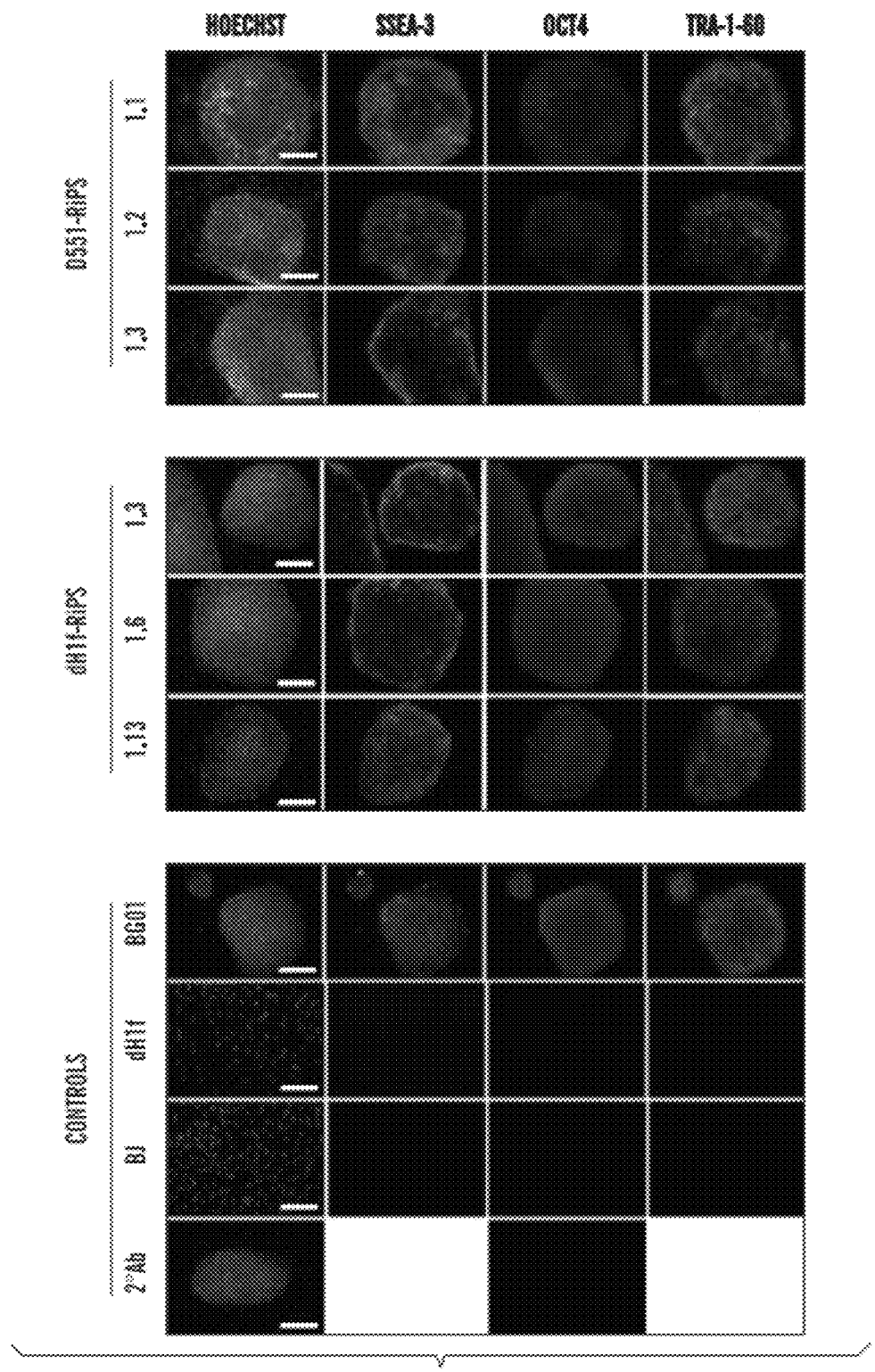
Figure 5C:
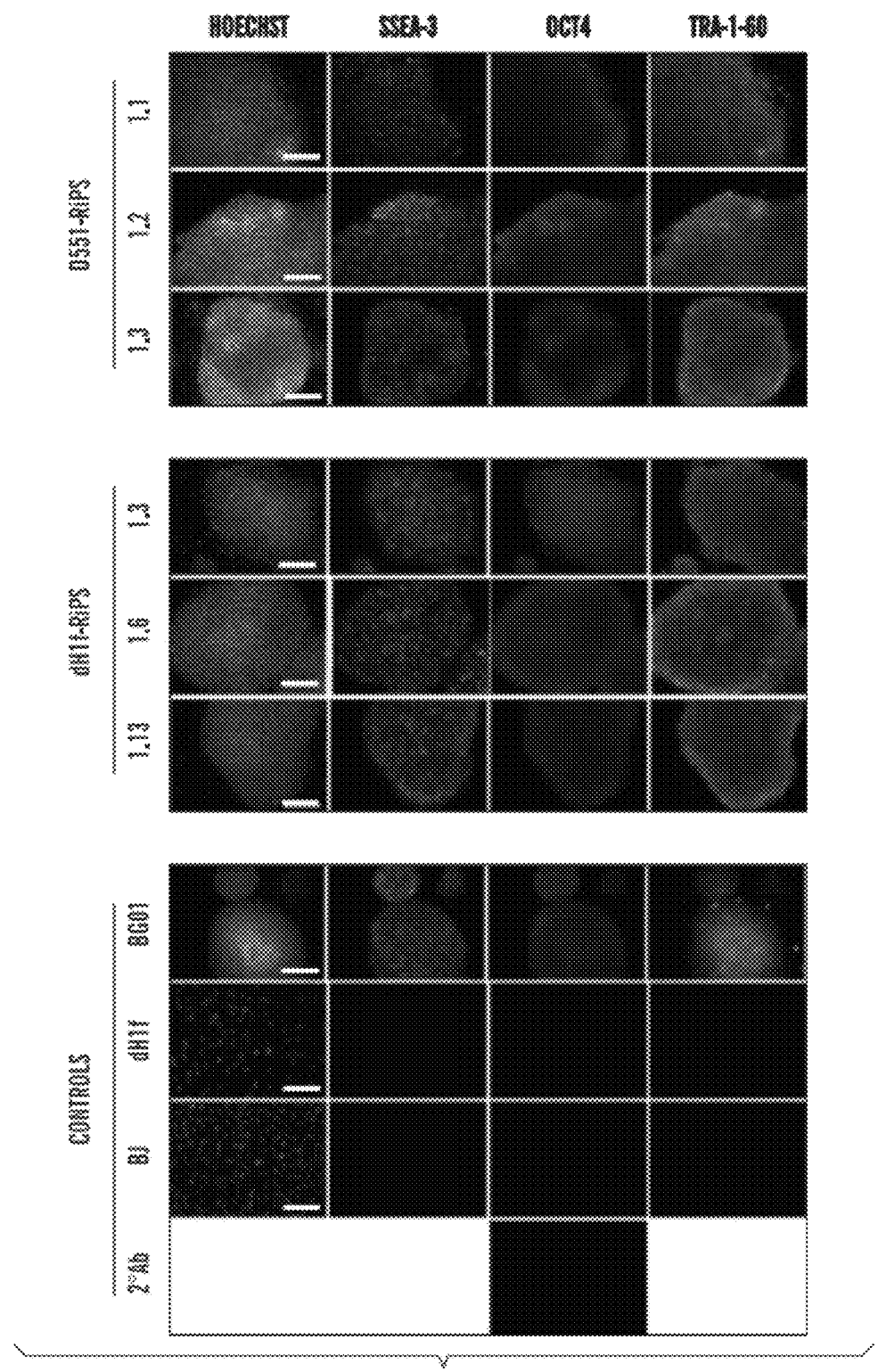

A protocol to ensure sustained high-level protein expression with daily transfection was next discovered by exploring a matrix of conditions encompassing a variety of different transfection reagents, culture media, feeder cell types, and RNA doses. Long-term reprogramming experiments were initiated with human ES-derived dH1f fibroblasts, which display relatively efficient viral-mediated iPS cell conversion (Chan et al., 2009; Park et al., 2008). Low-oxygen (5% O2) culture conditions and a KMOS stoichiometry of 1:1:3:1 were also employed, as these have been reported to promote efficient iPS conversion in viral-based methods (Kawamura et al., 2009; Papapetrou et al., 2009; Utikal et al., 2009; Yoshida et al., 2009). Synthetic, modified RNA encoding a short half-life nuclear GFP was spiked into the KMOS RNA cocktail to allow visualization of continued protein expression from modified RNA during the course of the experiment (FIGS. 5A-5B). Experiments conducted in this manner revealed widespread transformation of fibroblast morphology to a compact, epithelioid morphology within the first week of synthetic, modified RNA transfection, which was followed by emergence of canonical hES-like colonies with tight morphology, well-defined borders, and prominent nucleoli (FIG. 5C). RNA transfection was terminated on day 17, and three days later colonies were mechanically picked and expanded to establish 14 prospective iPS lines, designated dH1f-RiPS(RNA-derived iPS) 1-14.

Figure 4F:
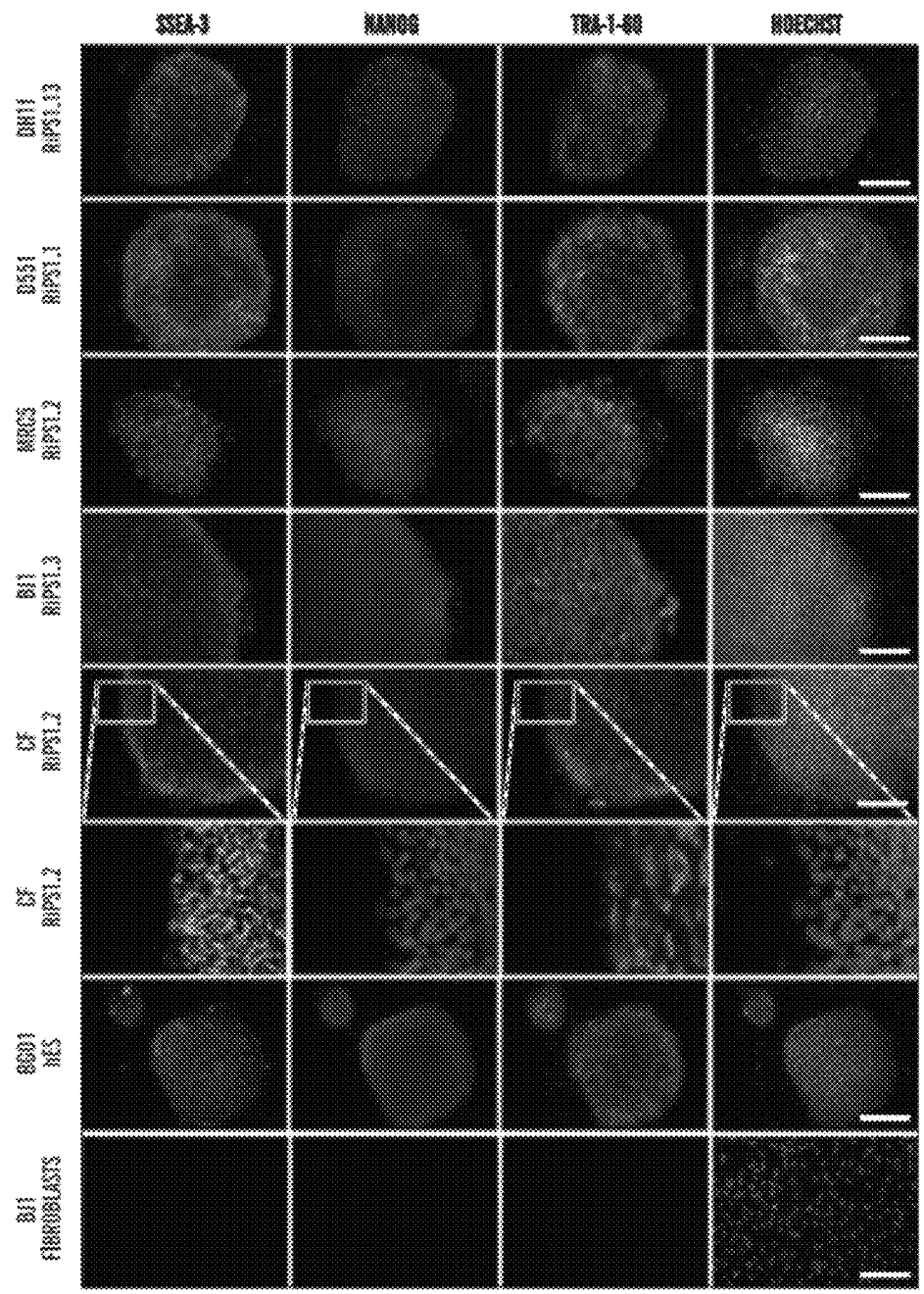
Figure 4F:
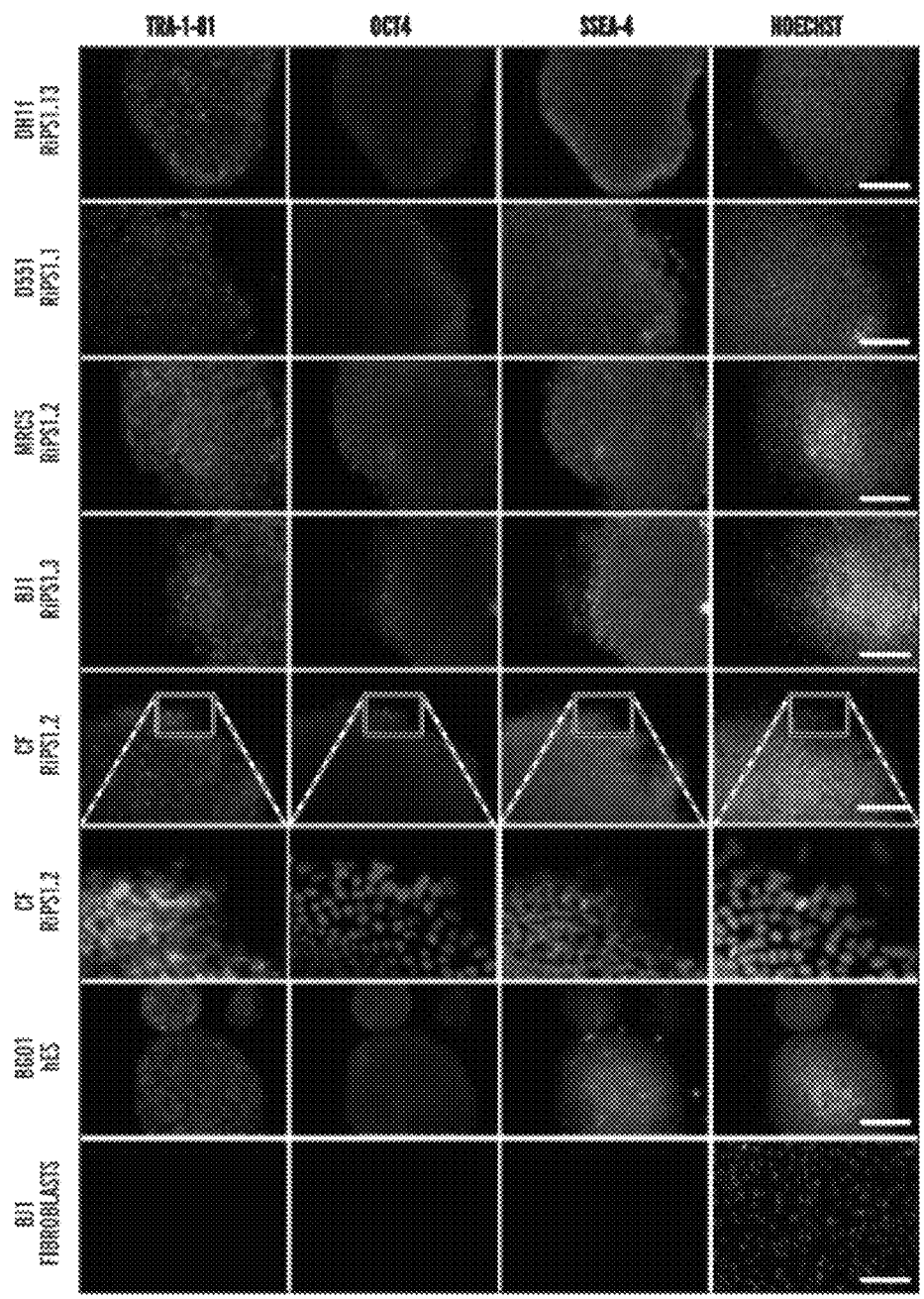
Figure 6A:
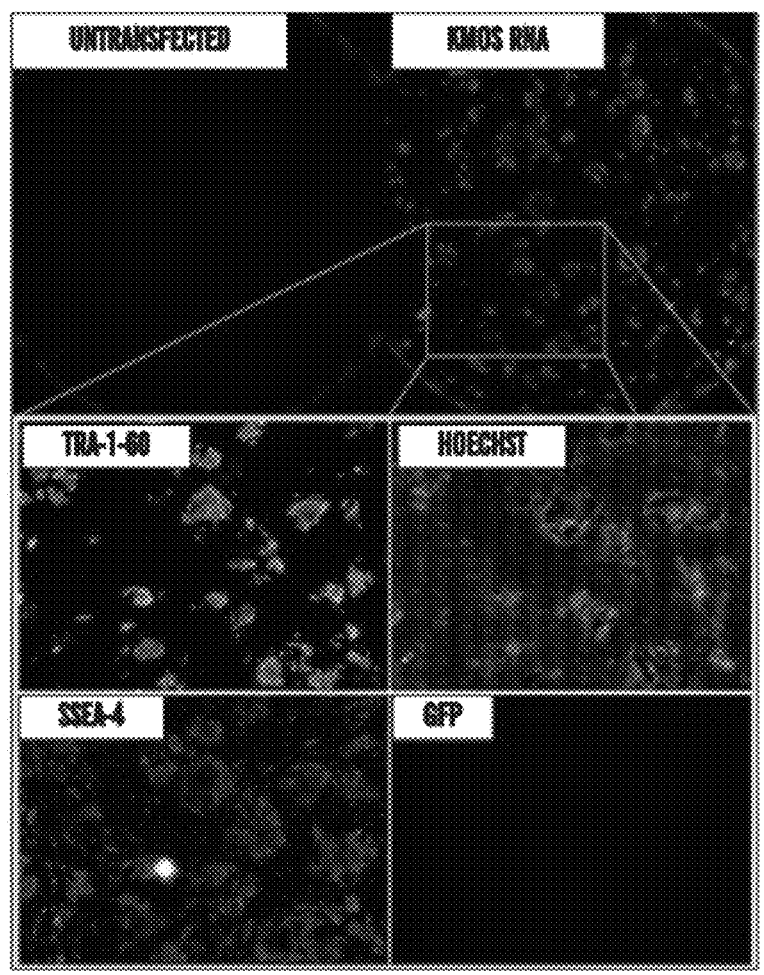
FIGS. 6A-6B demonstrate efficient RiPS derivation from BJ fibroblasts without passaging.
Figure 6B:
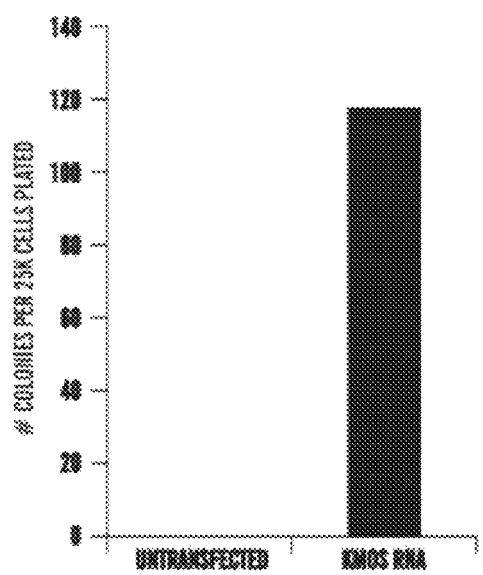

It was next attempted to reprogram somatically-derived cells to pluripotency using a similar reprogramming regimen. A five-factor cocktail including a modified RNA encoding LIN28 (KMOSL) (Yu et al., 2007) was employed and the media was supplemented with valproic acid (VPA), a histone deacetylase inhibitor, which has been reported to increase reprogramming efficiency (Huangfu et al., 2008). Four human cell types were tested: Detroit 551 (D551) and MRC-5 fetal fibroblasts, BJ post-natal fibroblasts, and fibroblast-like cells cultured from a primary skin biopsy taken from an adult cystic fibrosis patient (CF cells). Daily transfection with the modified RNA KMOSL cocktail gave rise to numerous hES-like colonies in the D551, BJ, and CF cultures that were mechanically picked at day 18, while MRC-5-derived colonies were picked at day 25. Multiple RiPS colonies were expanded for each of the somatic lines, and immunostaining confirmed the expression of hES markers TRA-1-60, TRA-1-81, SSEA3, SSEA4, OCT4, and NANOG in all the RiPS lines examined (FIG. 4F, FIG. 5C). Three RiPS cell clones from each of these four derivations were analyzed and confirmed to originate from the seeded somatic cells by DNA fingerprinting, and all presented normal karyotypes. In the experiments described above, the transfected fibroblast cultures were passaged once at an early time point (day 6 or 7) in order to promote fibroblast proliferation, which has been shown to facilitate reprogramming (Hanna et al., 2009). However, in independent experiments, RiPS cells were also derived from BJ and Detroit 551 fibroblasts in the absence of cell passaging, indicating that this was not required for modified RNA iPS-derivation (FIGS. 6A-6B).

Molecular Characterization and Functional Potential of RiPS Cells

Figure 7A:
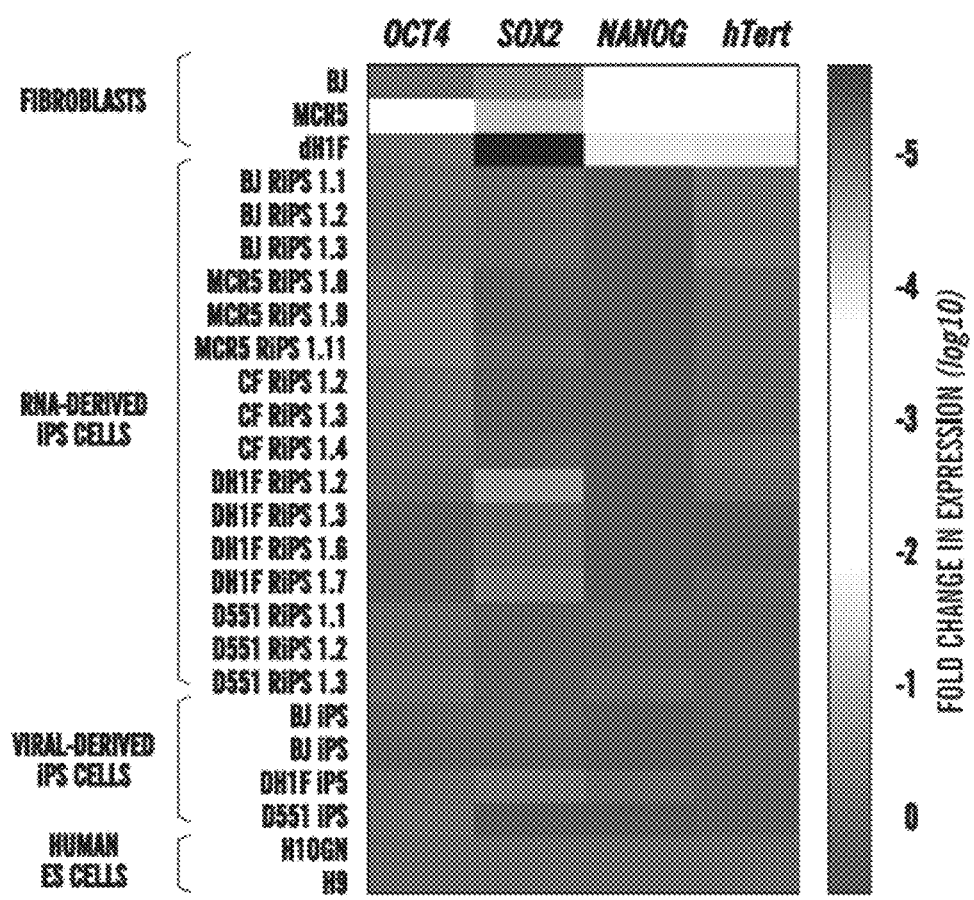
FIGS. 7A-7I demonstrate a molecular characterization of RiPS cells.
Figure 7B:
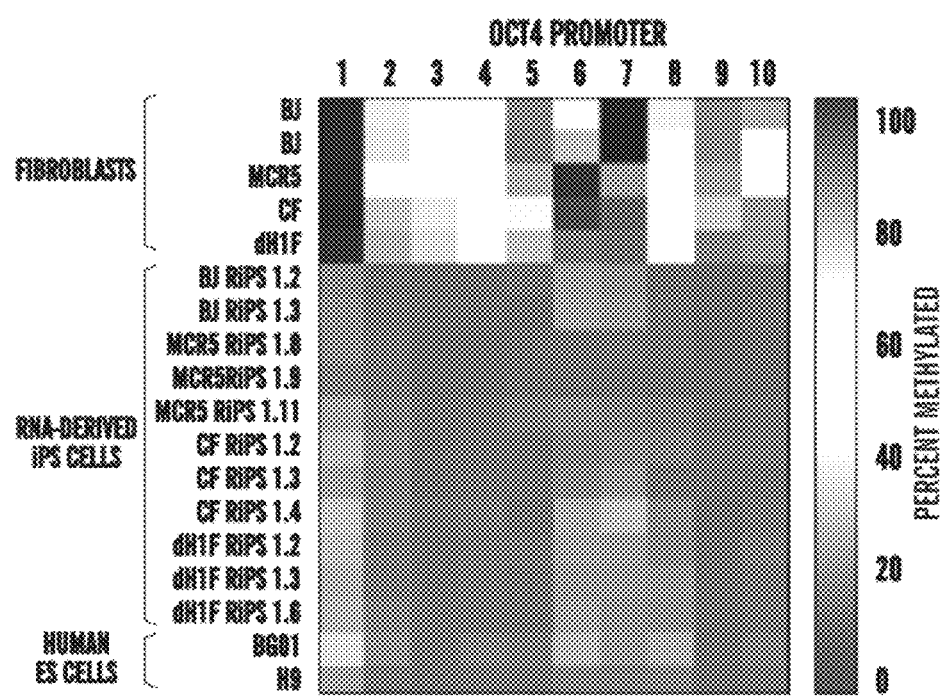
Figure 7C:
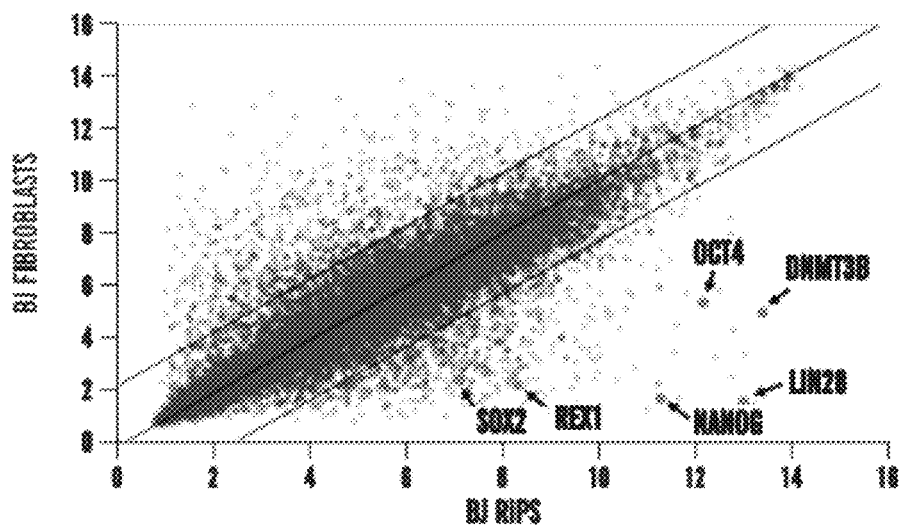
Figure 7D:
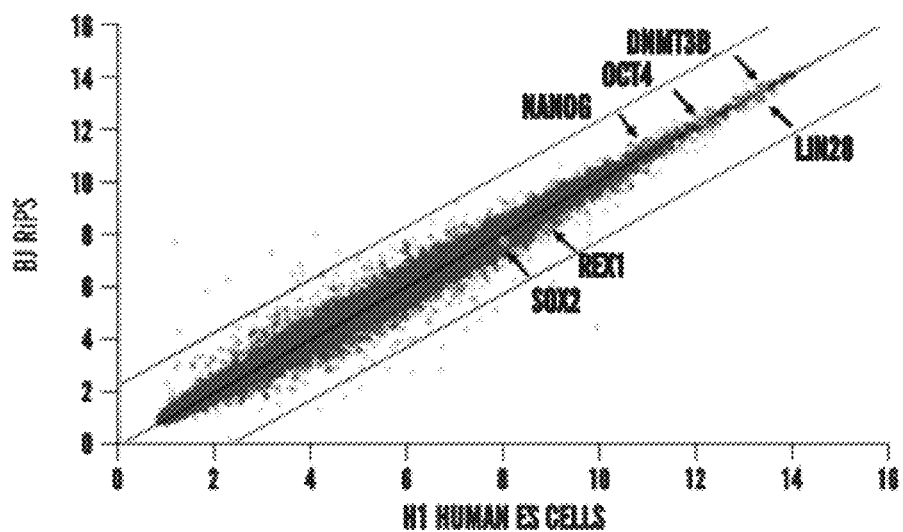
Figure 7E:
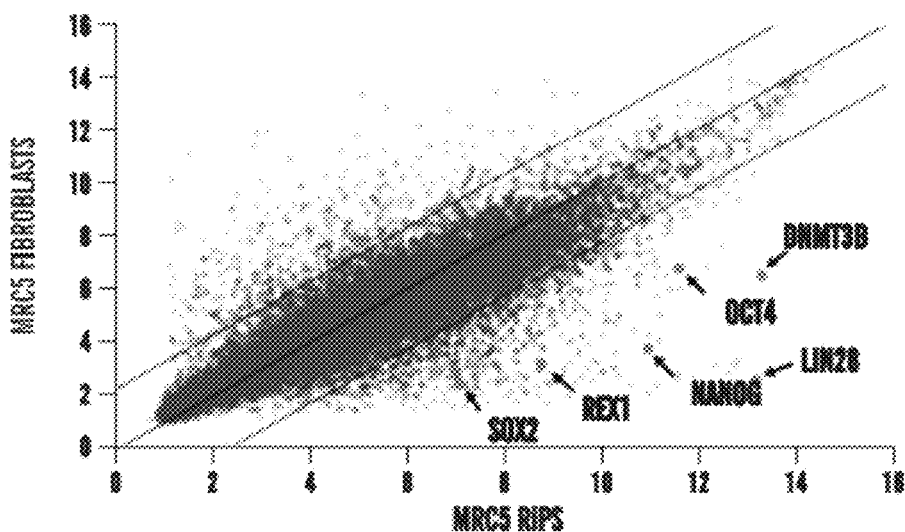
Figure 7F:
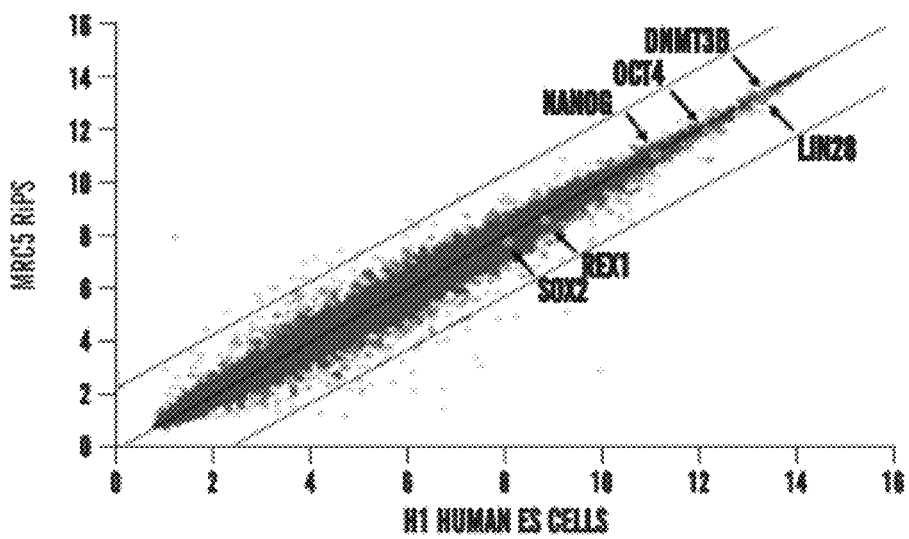
Figure 7G:
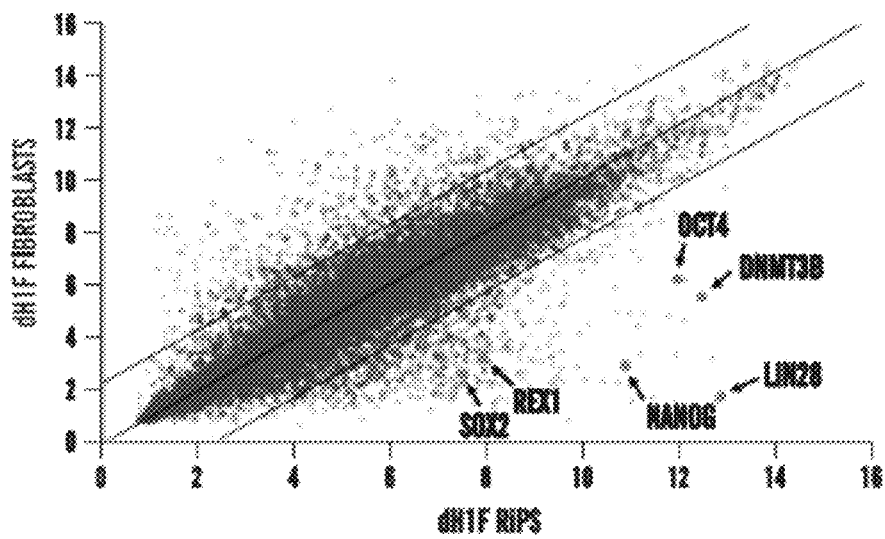
Figure 7H:
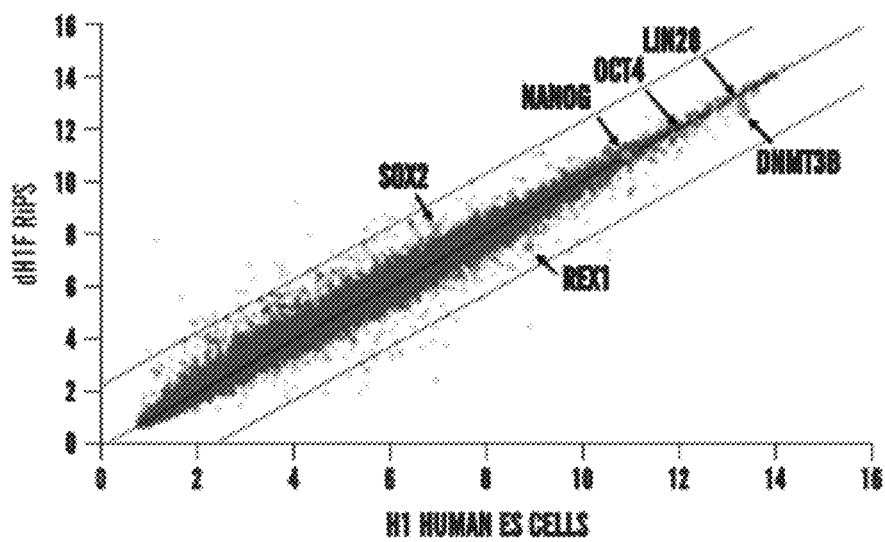

A number of molecular and functional assays were performed to assess whether the RiPS cells described herein had been reprogrammed to pluripotency (Table 6). Multiple RiPS lines derived from each of the five starting cell types were evaluated by quantitative RT-PCR (qRT-PCR), and all demonstrated robust expression of the pluripotency-associated transcripts OCT4, SOX2, NANOG, and hTERT (FIG. 7A). RiPS clones derived from dH1f, MRCS, BJ, and CF fibroblasts were further analyzed by bisulfite sequencing, which revealed extensive demethylation of the OCT4 locus relative to the parental fibroblasts, an epigenetic state equivalent to human ES cells (FIG. 7B).

TABLE 6

Pluripotency validation assays performed in this study.

| | | Bisulfite | | Developmental Potential | |
|---|---|---|---|---|---|
| Immunostaining[#] | qRT-PCR | Sequencing[Ω] | Microarray | In vitro | Teratoma |
| dH1F-RiPS-1.3 | dH1F-RiPS-1.2 | dH1F-RiPS-1.2 | dH1F-RiPS-1.2 | dH1F-RiPS-1.2[^†⊕*] | dH1F-RiPS-1.3 |
| dH1F-RiPS-1.6 | dH1F-RiPS-1.3 | dH1F-RiPS-1.3 | dH1F-RiPS-1.3 | dH1F-RiPS-1.6[^⊕] | dH1F-RiPS-1.5 |
| dH1F-RiPS-1.13 | dH1F-RiPS-1.6 | dH1F-RiPS-1.6 | dH1F-RiPS-1.6 | dH1F-RiPS-1.13[^⊕] | dH1F-RiPS-1.6 |
| BJ-RiPS-1.1 | dH1F-RiPS-1.7 | BJ-RiPS-1.2 | dH1F-RiPS-1.7 | dH1F-RiPS-1.14[^⊕] | dH1F-RiPS-1.7 |
| BJ-RiPS-1.2 | BJ-RiPS-1.1 | BJ-RiPS-1.3 | BJ-RiPS-1.1 | MCR5-RiPS-1.8[^†*] | dH1F-RiPS-1.11 |
| BJ-RiPS-1.3 | BJ-RiPS-1.2 | MCR5-RiPS-1.8 | BJ-RiPS-1.2 | MCR5-RiPS-1.9[^†*] | BJ-RiPS-1.1 |
| MCR5-RiPS-1.2 | BJ-RiPS-1.3 | MCR5-RiPS-1.9 | BJ-RiPS-1.3 | MCR5-RiPS-1.11[^*] | BJ-RiPS-1.2 |
| MCR5-RiPS-1.3 | MCR5-RiPS-1.8 | MCR5-RiPS-1.11 | MCR5-RiPS-1.8 | BJ-RiPS-1.1[^†⊕*] | CF-RiPS-1.2 |
| MCR5-RiPS-1.11 | MCR5-RiPS-1.9 | CF-RiPS-1.2 | MCR5-RiPS-1.9 | BJ-RiPS-1.2[^†⊕*] | |
| CF-RiPS-1.2 | MCR5-RiPS-1.11 | CF-RiPS-1.3 | MCR5-RiPS-1.11 | BJ-RiPS-1.3[^†*] | |
| CF-RiPS-1.3 | CF-RiPS-1.2 | CF-RiPS-1.4 | CF-RiPS-1.2 | CF-RiPS-1.2[^†*] | |
| CF-RiPS-1.4 | CF-RiPS-1.3 | | CF-RiPS-1.3 | CF-RiPS-1.3[^†*] | |
| D551-RiPS-1.1 | CF-RiPS-1.4 | | CF-RiPS-1.4 | CF-RiPS-1.4[^⊕*] | |
| D551-RiPS-1.2 | D551-RiPS-1.1 | | | D551-RiPS-1.1[^†*] | |
| D551-RiPS-1.3 | D551-RiPS-1.2 | | | D551-RiPS-1.2[^*] | |
| | D551-RiPS-1.3 | | | D551-RiPS-1.3[^*] | |

Table 6 shows the RiPS clones that were validate in each assay. [#]Validated for immuno-staining for all of TRA-1-60, TRA-1-80, SSEA3, SSEA4, OCT4, NANOG. [Ω]Demethylation of the OCT4 promoter. In vitro differentiation including ^embryoid body formation, ⊕trilineage by directed differentiation, †beating cardiomyocytes, and *blood formation by CFC assays in methylcellulose.

Table 6 shows the RiPS clones that were validate in each assay. # Validated for immuno-staining for all of TRA-1-60, TRA-1-80, SSEA3, SSEA4, OCT4, NANOG. Ω Demethylation of the OCT4 promoter. In vitro differentiation including ^embryoid body formation, ⊕trilineage by directed differentiation, † beating cardiomyocytes, and * blood formation by CFC assays in methylcellulose.

Figure 7I:
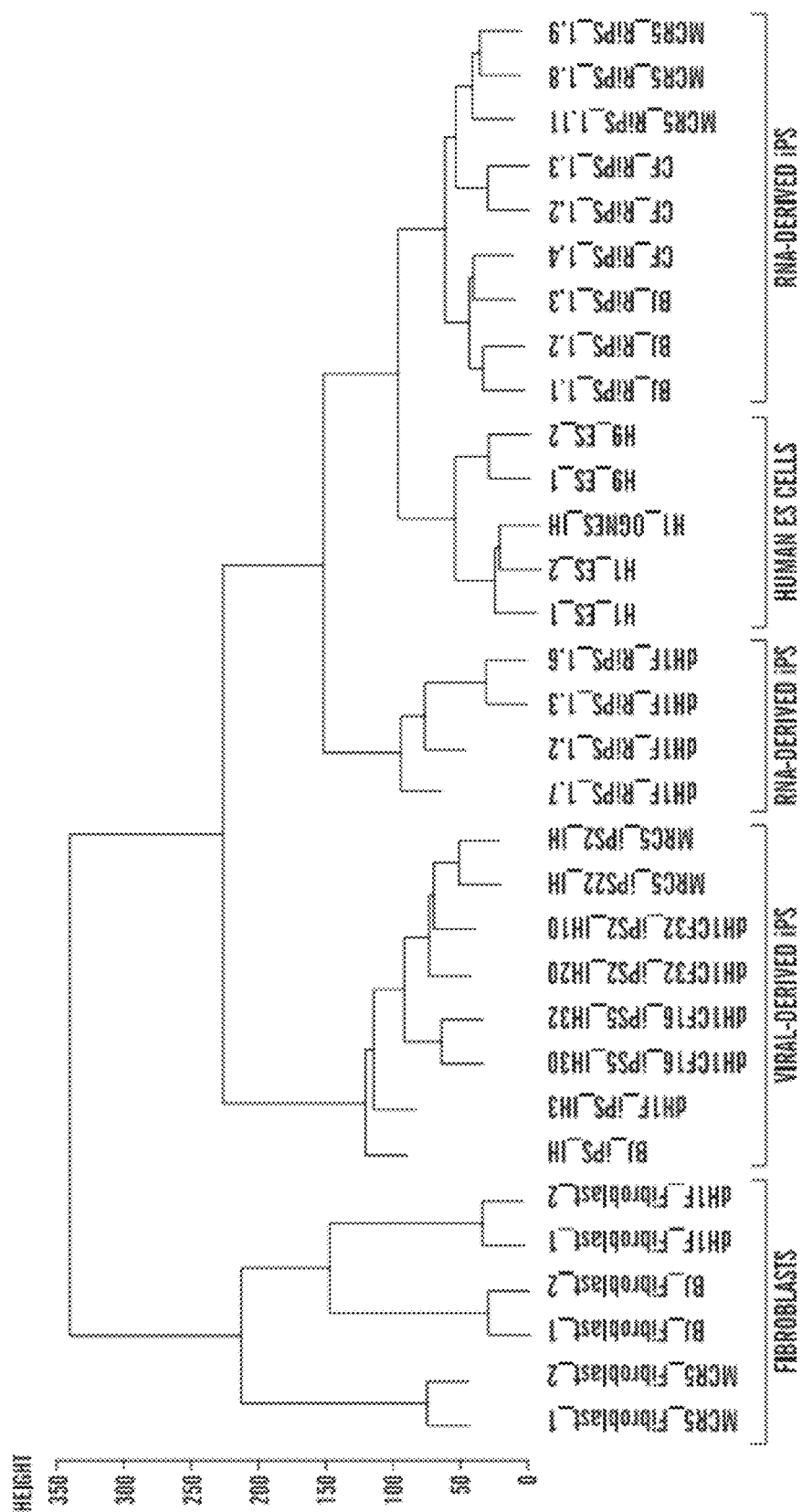

To gain more global insight into the molecular properties of RiPS cells, gene expression profiles of RiPS clones from multiple independent derivations were generated and compared to fibroblasts, human embryonic stem (ES) cells, and virally-derived iPS cell lines. These analyses revealed that all synthetic, modified RNA-derived iPS clones examined had a molecular signature that very closely recapitulated that of human ES cells while being highly divergent from the profile of the parental fibroblasts (FIGS. 7C-7H). Importantly, pluripotency-associated transcripts including SOX2, REX1, NANOG, OCT4, LIN28 and DNMT3B were substantially upregulated in the RiPS cells compared to the parental fibroblast lines to levels comparable to human ES cells (FIGS. 7C-7H). Furthermore, when the transcriptional profiles were subjected to unsupervised hierarchical clustering analysis, all RiPS clones analyzed clustered more closely to human ES cells than did virally-derived iPS cells, indicating that synthetic, modified RNA-derived iPS cells more fully recapitulated the molecular signature of human ES cells (FIG. 7I).

Figure 8A:
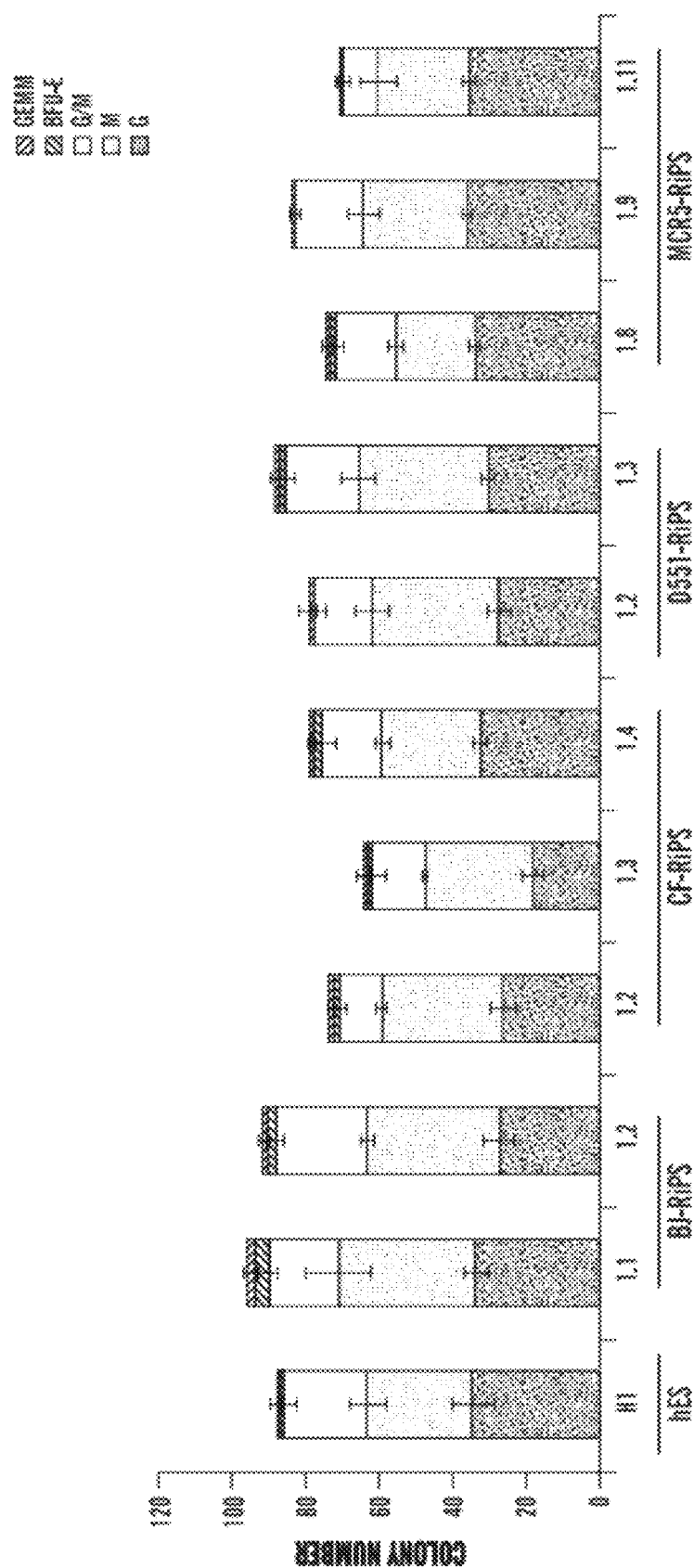
FIGS. 8A-8C demonstrate trilineage differentiation of RiPS cells.
Figure 8B:
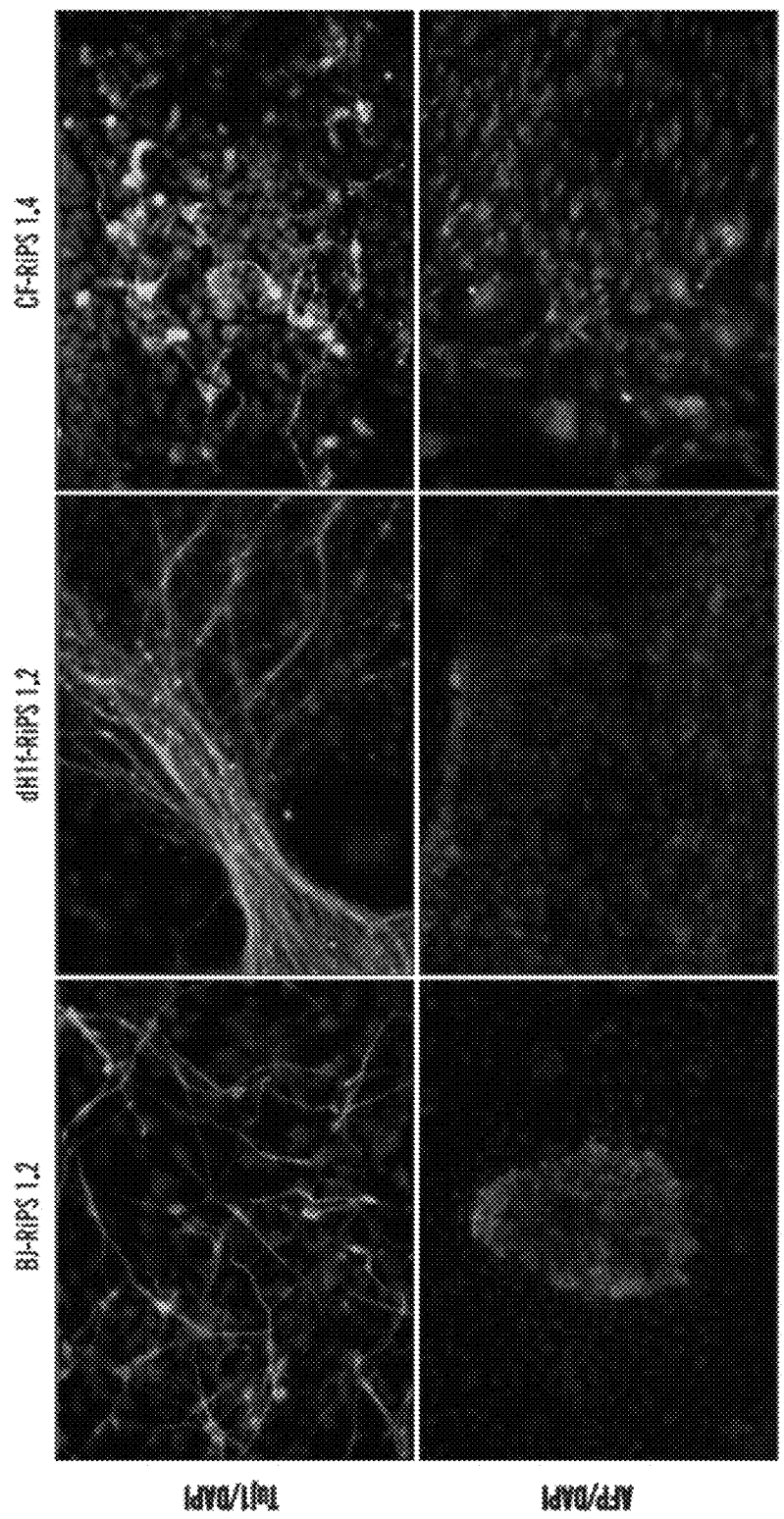
Figure 8C:
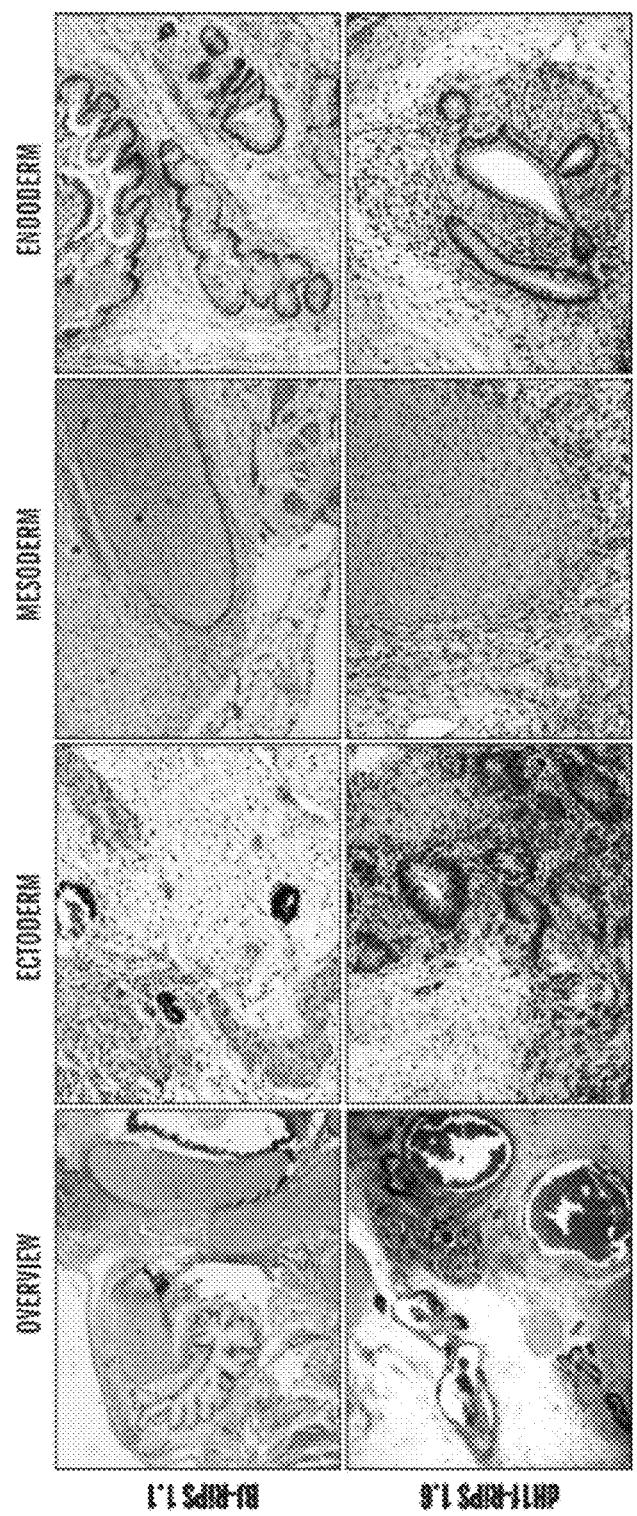
Figure 9:
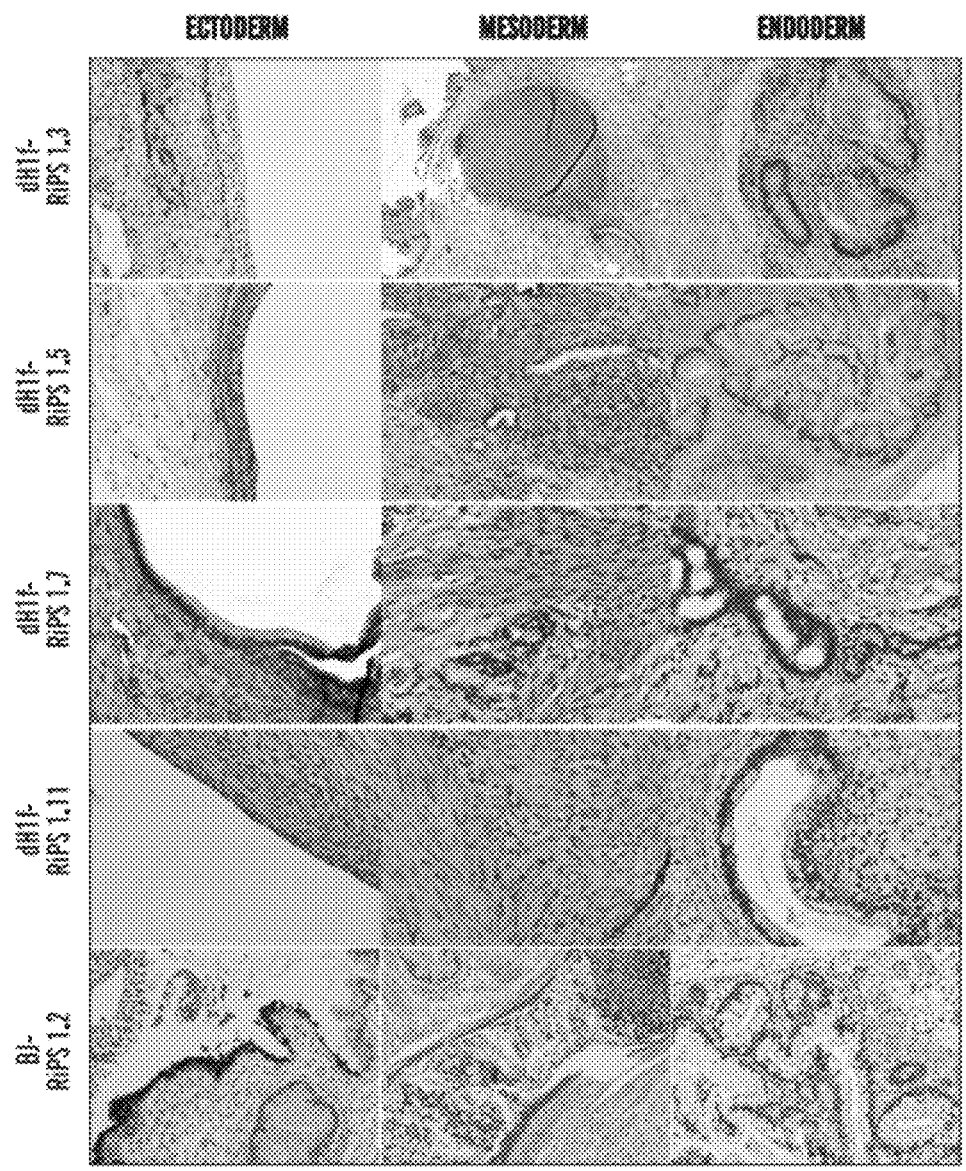
FIG. 9 demonstrates teratoma formation and trilineage differentiation of synthetic, modified RNA derived iPS clones in vivo.

To evaluate the developmental potential of RiPS cells, embryoid bodies (EBs) were generated from multiple clones representing five independent RiPS derivations. Beating cardiomyocytes were observed for vast majority of the EBs (Table 6). Mesodermal potential was further evaluated in methylcellulose assays which showed that all lines tested were able to differentiate into hematopoietic precursors capable of giving rise to colony numbers and a spectrum of blood colony types comparable to human ES cells (FIG. 8A, Table 6). A subset of clones was further plated onto matrigel and differentiated into Tuj1-positive neurons (ectoderm), and alpha-fetoprotein-positive endodermal cells (FIG. 8B, Table 6). Finally, tri-lineage differentiation potential was confirmed in vivo by the formation of teratomas from dH1F-, CF- and BJ-RiPS cells, that histologically revealed cell types of the three germ layers (FIG. 8C, FIG. 9, Table 6).

Taken together, these data demonstrate by the most stringent molecular and functional criteria available in regard to human pluripotent cells (Chan et al., 2009; Smith et al., 2009), that the synthetic, modified RNA-derived iPS clones from multiple independent derivations described herein were reprogrammed to pluripotency, and closely recapitulated the functional and molecular properties of human ES cells. Significantly, these synthetic, modified RNA-derived iPS clones had molecular properties more similar to human ES cells than did cells that were reprogrammed using standard, viral-based methods.

Modified RNAs Generate iPS Cells at Very High Efficiency

Figure 10A:
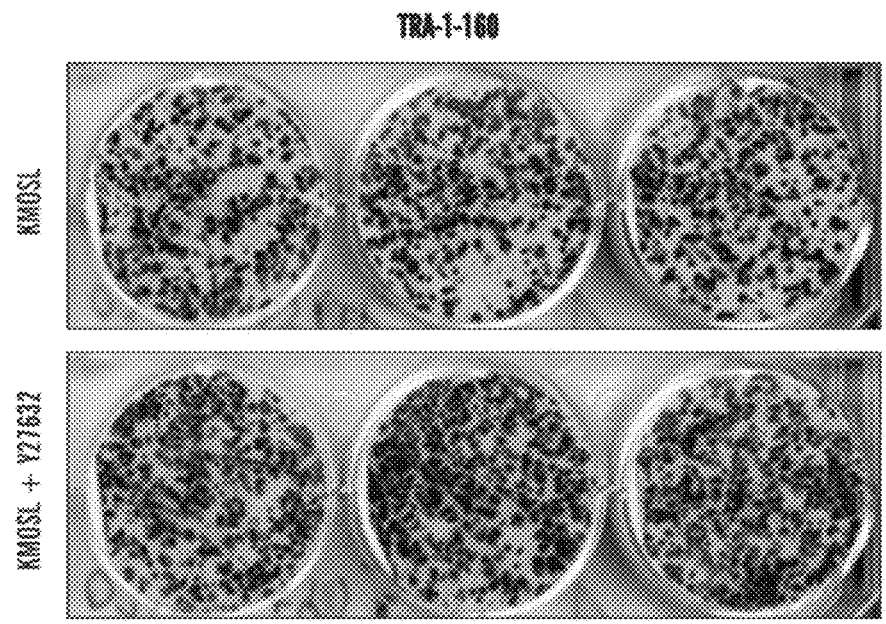
FIGS. 10A-10E demonstrates high and surprising efficiency of pluripotency induction by synthetic, modified RNAs.
Figure 10B:
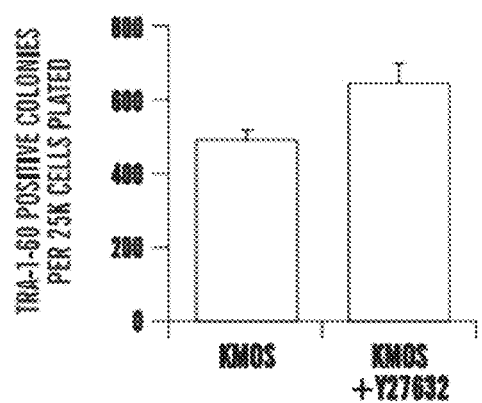

During the course of the experiments, surprisingly high reprogramming efficiencies and rapid kinetics of iPS cell generation using the synthetic, modified RNAs described herein were observed. To quantify the efficiency of RiPS derivation more thoroughly, a number of reprogramming experiments were undertaken and results quantitated based on the expression of the iPS-specific markers TRA-1-60 and TRA-1-81, (Chan et al., 2009; Lowry et al., 2008). In one set of experiments, BJ fibroblasts transfected with a five-factor modified RNA cocktail (KMOSL), this time without the use of VPA, demonstrated an iPS conversion efficiency of over 2%, which is two orders of magnitude higher than typically reported for virus-based derivations (FIGS. 10A-10B, Table 7). Moreover, in contrast to virus-mediated BJ-iPS derivations, in which iPS colonies typically take around 4 weeks to emerge, by day 17 of RNA transfection the plates had already become overgrown with ES-like colonies (FIG. 10A).

TABLE 7

Quantification of reprogramming efficiency.

| Experiment | Cells plated | Split | Condition | Well fraction | Colonies/well | Efficiency (%) |
|---|---|---|---|---|---|---|
| BJ (KMOSL) | 300,000 | d7 | Y27632− | 1/24 | 249 ± 21 | 2.0 |
|  |  |  | Y27632+ | 1/24 | 326 ± 49 | 2.6 |
| 4-Factor | 50,000 | d6 | 4F 20% $O_2$ | 1/6 | 48 ± 18 | 0.6 |
| (KMOS) |  |  | 4F 5% $O_2$ | 1/6 | 228 ± 30 | 2.7 |
| vs. |  |  | 5F 20% $O_2$ | 1/6 | 243 ± 42 | 2.9 |
| 5-Factor |  |  | 5F 5% $O_2$ | 1/6 | 367 ± 38 | 4.4 |
| (KMOSL) |  |  |  |  |  |  |
| RNA vs. Virus | 100,000 | d6 | Virus | 1/3 | 13 ± 3.5 | 0.04 |
| (KMOS) |  |  | RNA | 1/6 | 229 ± 39 | 1.4 |

For each experimental condition, efficiency was calculated by dividing the average count of TRA-1-60-positive colonies per well by the initial number of cells plated, scaled to the fraction of cells replated in each well. Cultures were passaged at day 6 or 7 as indicated. The BJ experiment was started in a 10-cm dish, dH1f trials in individual wells of a 6-well plate. Colony counts are shown ±s.d., n=6, except in the RNA vs. Virus trial, where n=9 for virus, n=18 for RNA.

Figure 10C:
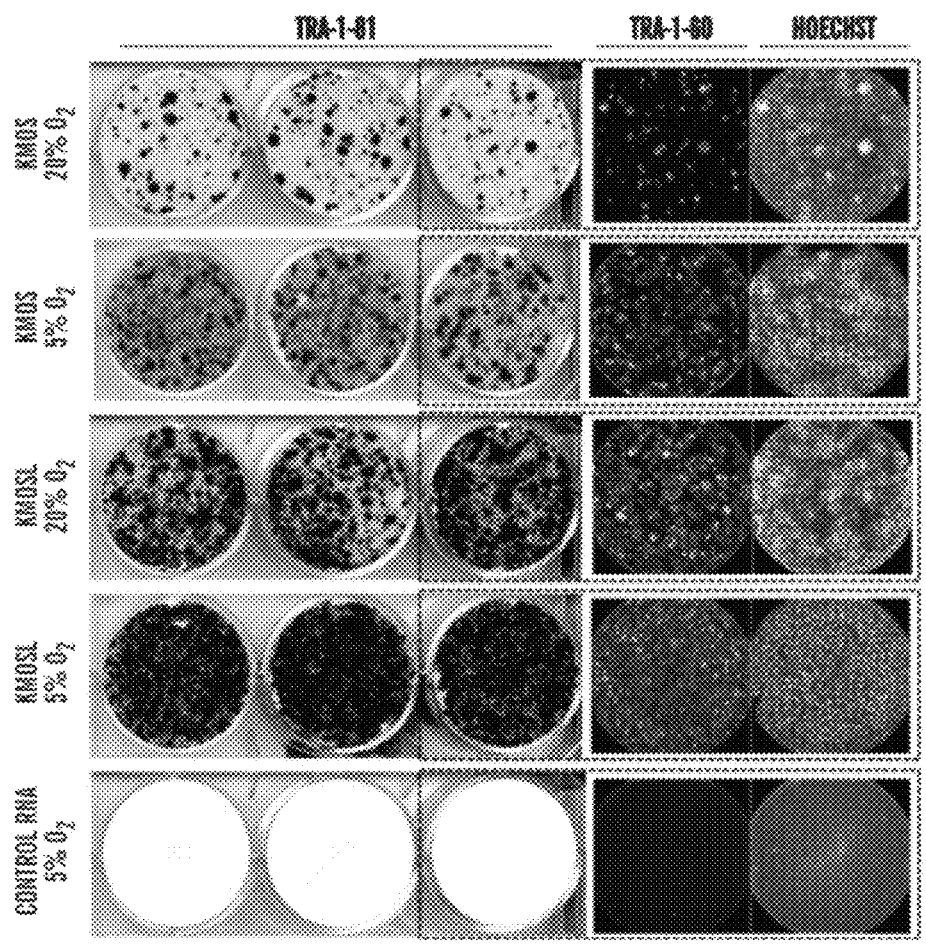
Figure 10D:
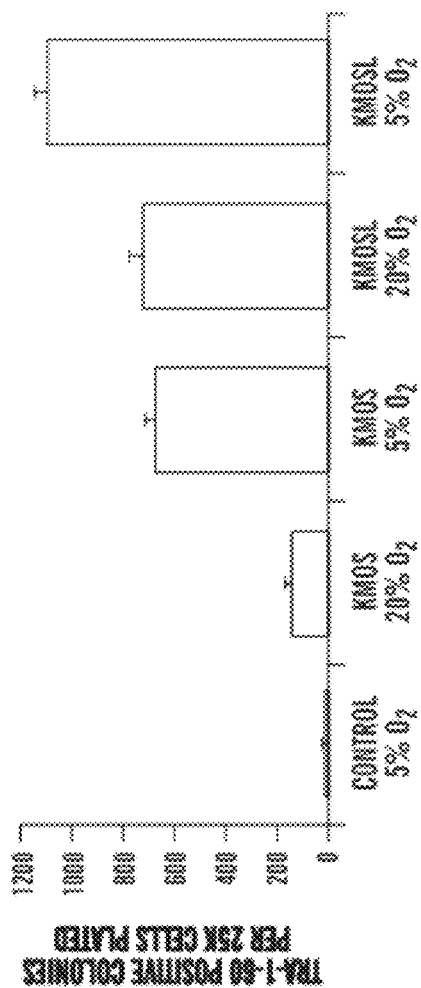

In another set of experiments, the contributions of low-oxygen culture and LIN28 to the efficiency of RiPS derivation were evaluated. The yield of TRA-1-60/TRA-1-81-positive colonies in the ambient (20%) oxygen condition was four-fold lower than in the cultures maintained at 5% O2 when using KMOS RNA, but this deficit was negated when LIN28 was added to the cocktail (FIGS. 10C-10D, Table 7). The highest conversion efficiency (4.4%), which is higher than any reported conversion efficiency, was observed when low-oxygen culture and the five-factor KMOSL cocktail were combined.

Figure 10E:
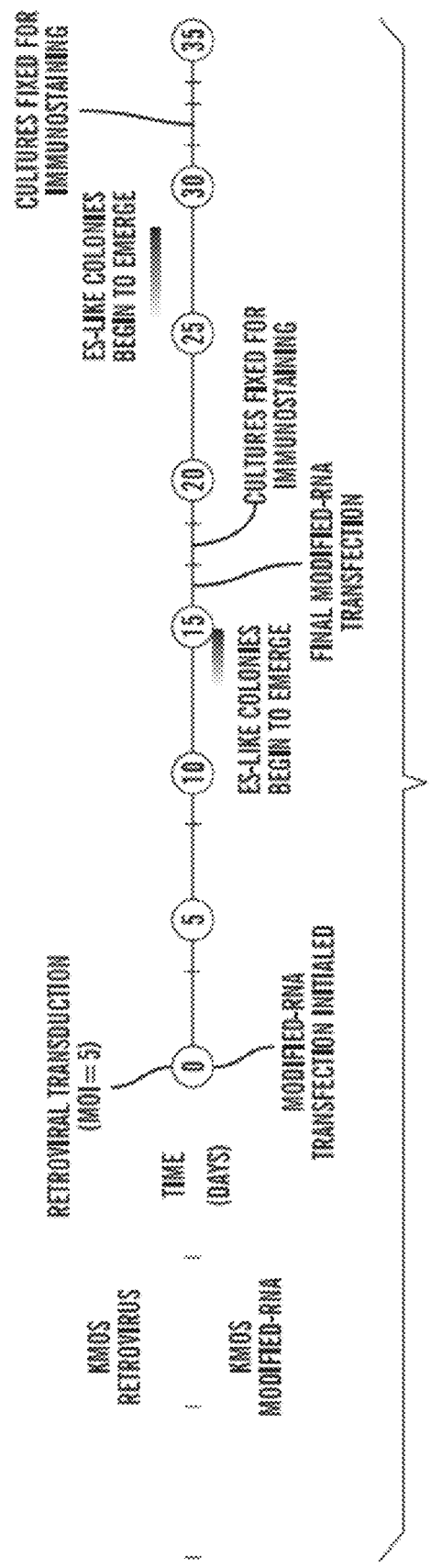
Figure 10F:
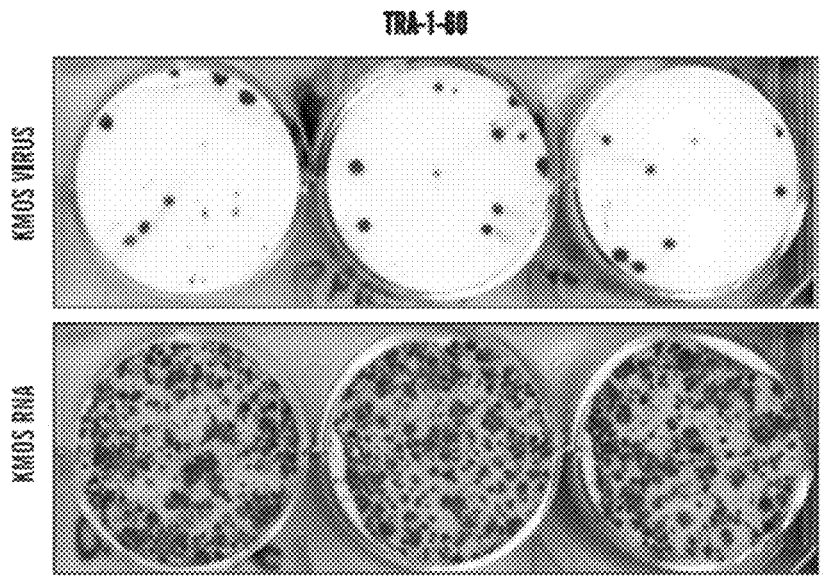
Figure 10G:
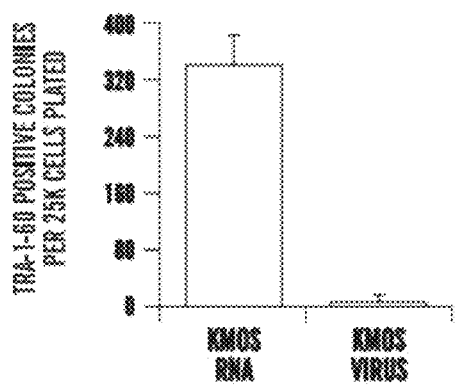

To directly compare the kinetics and efficiency of the RiPS derivation protocol against an established viral protocol, an experiment in which dH1f fibroblasts were transfected with KMOS synthetic, modified RNAs, or transduced with KMOS retroviruses in parallel was conducted. As had been observed in the previous experiments described herein, ES-like colonies began to emerge by day 13 from the synthetic, modified RNA-transfected cultures, and the plates became overgrown with ES-like colonies by the 16th and final day of transfection. These synthetic, modified RNA-derived cultures were therefore fixed for analysis on day 18 (FIGS. 10E-10G). Notably, at this time, no ES-like colonies had appeared in the retrovirally transduced cultures, and colonies only began to emerge on the 24th day post-transduction, which is a time point consistent with previous reports describing iPS derivations by retroviruses (Lowry et al., 2008; Takahashi et al., 2007). These retroviral-derived cultures were fixed for analysis on day 32. Both arms of the experiment were then immunostained and TRA-1-60-positive colonies were counted. These experiments revealed that the kinetics of modified RNA iPS derivation were almost twice as fast as retroviral iPS derivation. Further, and importantly, iPS derivation efficiencies were 1.4% for synthetic, modified RNA cultures, and only 0.04% for retroviral cultures, corresponding to a surprising 36-fold higher conversion efficiency with the synthetic, modified RNA compositions and protocols (FIGS. 10E-10G, Table 7). Thus, by the combined criteria of colony numbers and kinetics of reprogramming, the efficiency of synthetic, modified RNA iPS derivation greatly exceeds that of conventional retroviral approaches.

Utilization of Synthetic, Modified RNA to Direct Differentiation of Pluripotent RiPS Cells to a Terminally-Differentiated Cell Fate.

Figure 11A:
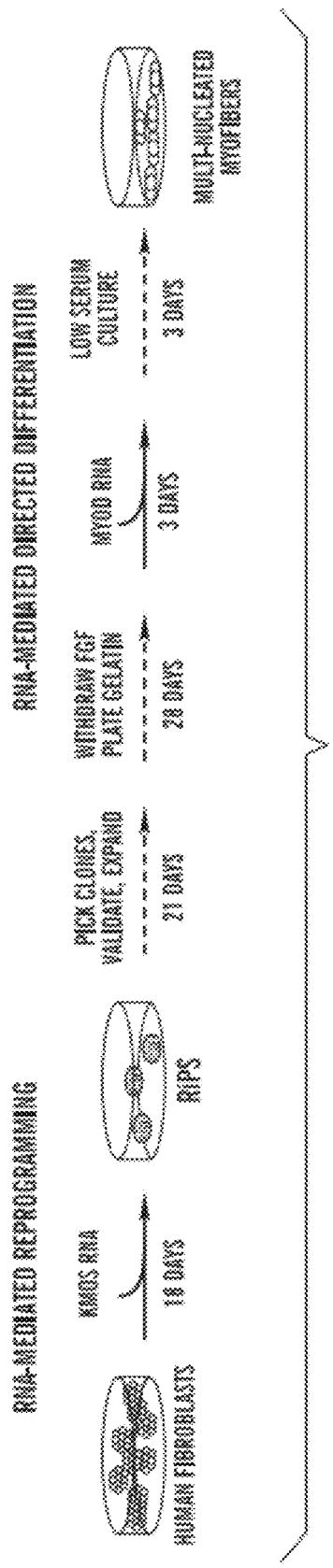
FIGS. 11A-11C demonstrate efficient directed differentiation of RiPS cells to terminally differentiated myogenic fate using synthetic, modified RNA.
Figure 11B:
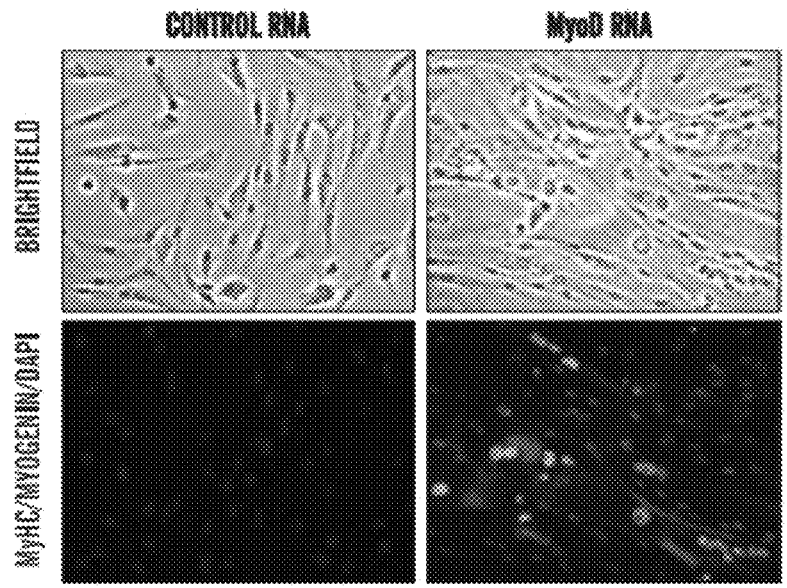
Figure 11C:
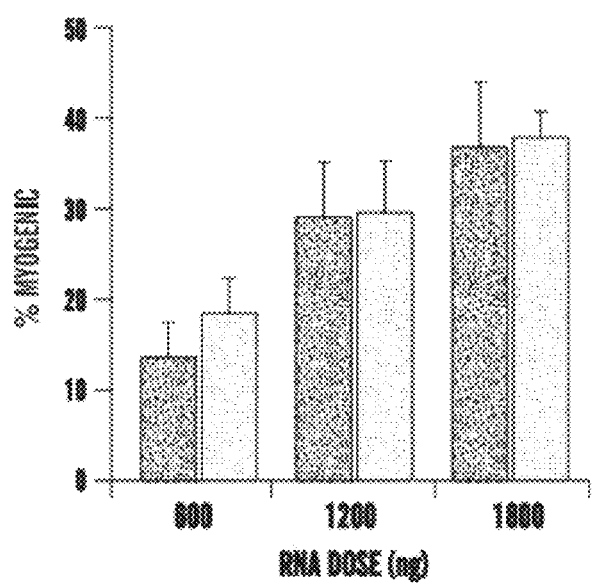

To realize the promise of iPS cell technology for regenerative medicine or disease modeling, it is imperative that the multi-lineage differentiation potential of pluripotent cells be harnessed. Although limited progress has been made in directing the differentiation of pluripotent ES cells to various lineages by modulating the extracellular cytokine milieu, such protocols remain inefficient. Given the high efficiency of iPS derivation by the novel synthetic, modified RNAs and methods thereof described herein, whether this technology could also be utilized to redirect pluripotent or multipotent cells towards differentiated cell fates was also determined. To test this, one of the validated RIPS lines described herein was subjected to an in vitro differentiation protocol in which FGF was withdrawn, serum added, and the cells plated onto gelatin (FIGS. 11A-11C). Cells obtained under these conditions were subjected to three consecutive days of transfection with a MYOD-encoding synthetic, modified RNA to provoke myogenic differentiation. The cells were then cultured an additional three days and then immunostained for the myogenic markers myogenin and MyHC, which revealed a high percentage of large multi-nucleated myogenin and MyHC double positive myotubes (FIGS. 11A-11C).

Taken together, the experiments described herein provide clear proof that synthetic, modified RNAs can be used to both reprogram cells to a pluripotent state at high and unexpected efficiencies, and also direct the fate of such cells and other pluripotent or multipotent cells to cells having lower developmental potential, such as a terminally differentiated somatic cell type.

DISCUSSION

Described herein are novel compositions and technologies that use a combination of synthetic RNA modifications, and in some embodiments, a soluble interferon inhibitor, to overcome innate anti-viral responses and permit repeated transfections with RNA, thus enabling highly efficient alterations in cellular phenotypes and developmental potentials, such as highly efficient reprogramming of somatic cells to pluripotency, and directing the differentiation of pluripotent cells towards a desired lineage. The novel methodologies and compositions described herein offer several key advantages over established reprogramming techniques. By obviating the need to perform experiments under stringent biological containment, synthetic, modified RNA technology makes reprogramming accessible to a wider community of researchers. More fundamentally, the approaches described herein allow protein stoichiometry to be regulated globally within cultures, while avoiding the stochastic variation of expression typical of integrating vectors, as well as the uncontrollable and undesired effects of viral silencing. Given the stepwise character of the phenotypic changes observed during pluripotency induction (Chan et al., 2009; Smith et al., 2010), individual transcription factors can play distinct, stage-specific roles during reprogramming. The unprecedented potential for temporal control over factor expression afforded by the technologies described herein can help researchers unravel these nuances, yielding further insights that can be applied to further enhance the efficiency and kinetics of reprogramming.

While the risk of mutagenesis is a major safety concern holding back clinical exploitation of induced pluripotency, other factors also play a role. It has become increasingly apparent that all iPS cells are not created equal with respect to epigenetic landscape and developmental plasticity (Hu et al., 2010; Miura et al., 2009). In this regard, the most stringent molecular and functional criteria for reprogramming human cells have been applied herein (Chan et al., 2009; Smith et al., 2009), to demonstrate that the iPS clones derived from synthetic, modified RNAs from multiple independent derivations were reprogrammed to pluripotency, and also closely recapitulated the functional and molecular properties of human ES cells. Significantly, as described herein, synthetic, modified RNA derived iPS cells more faithfully recapitulated the global transcriptional signature of human ES cells than retrovirally-derived iPS cells, indicating that the compositions and methods for RNA reprogramming described herein produce higher quality iPS cells, possibly owing, without wishing to be bound or limited by theory, to the fact that they are transgene-free.

The transient and non-mutagenic character of RNA-based protein expression can also deliver important clinical benefits, in some embodiments, outside the domain of lineage reprogramming and alteration of cellular developmental potential. The use of RNA transfection to express cancer or pathogen antigens for immunotherapy is already an active research area (Rabinovich et al., 2008; Rabinovich et al., 2006; Van den Bosch et al., 2006; Weissman et al., 2000), and the synthetic, modified RNA can be used, in some embodiments, to transiently express surface proteins, such as homing receptors, to target cellular therapies toward specific organs, tissues, or diseased cells (Ryser et al., 2008).

For tissue engineering to progress further, there is a pressing need for safe and efficient means to alter cellular fates. In terms of personalized medicine applications, iPS cells are a starting point for patient-specific therapies, and specification of clinically useful cell types is required to produce autologous tissues for transplantation or for disease modeling. Importantly, the inventors have demonstrated that the synthetic, modified RNA-based technologies described herein that enable highly efficient reprogramming, can are equally applicable to efficiently alter pluripotent cell fate to terminally differentiated fates without compromising genomic integrity. In light of these considerations, the novel compositions and approaches described herein can become central enabling technology for cell-based therapies and regenerative medicine.

SEQUENCE LISTING (1501 sequences)

SEQ ID NO: 1 - DNA, 428 bp, Homo sapiens
  modified_base (422)..(422): a, c, t, g, unknown or other
tttttttttttcataccgtattcatttttttatttaacttggggatggaatggggatagcatacattttatttgtacaatatttaacaatcacttatccaaggtggggttttatggggattttaagctttctgttaaatacttgcagaaaaaatagcaagtacgatttgacagtagtacaataacctgtgcccaaaacacaagaaatacagagtaaagcgaaaataactgcttaccaatattctgagaggtaacaaatgggatatgggttgagactgcataaaaaacgtactgctggttgaatatctgaggtaaatgatgttcaatcaagatgctacttgtatcattttgcccataaatggataaataattttatgcatatcataccaaatggttcctaaaaagtaatctttccaaaaagtntaaaag

SEQ ID NO: 2 - DNA, 407 bp, Homo sapiens
agcaggtcctgagtgtcaggaattcagattctctgccccactcctgctggataggaggacacttccactagaacctgggcctggcctttccagttttctgctgggagtccggattctggtgctttgctccgaagcagtgcccgtgggctccgggctggctcatcatcacagcttctctgctcagtgaggagaccatcattgtgctgcttttctgatgccttccatttgcctttttctccacttgggaaaaacaaaaaaagctagtatgctacatcctgaaaagttgttaatccttcaccaccacatacattgaaaaatcagttcctgccgggaagtaccactaaaggcatattgtaaactttttttctaattggaaaggtaaactttttttcccccataactatttt

SEQ ID NO: 3 - DNA, 2172 bp, Homo sapiens
aatcccttcaaccttctgcgcgcttccgccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctctgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgcggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgccaaaaaaaaaaaaaaaaaaaaaaaaaaaaaaaa

SEQ ID NO: 4 - DNA, 6505 bp, Homo sapiens
gacagatttcaatgtctgttgaaggcccccccacaccctccttcagtgccgggggcatggagggatatcttgggctcctgctgttttttaaaatgatgcgagctcatctcctgtcctgggtgtgaacgagtatatcttaccagggatgtaactgaacatttttttctgcattgtgttcctactgagcaacccaagatggccaggaactgctctgagtgcaaggagaagagggcagcacatatcctctgcacctactgcaatcgctggctgtgcagctcttgcacagaggaacaccgacacagccctgtccccgggggcccattctttcctcgggcccagaagggatctccaggagtgaatggtggtcccggagacttcaccttgtattgtcctctacacacacaggaagtactcaagctattctgtgagacatgtgatatgctcacttgccatagctgcctagtggtggaacacaaagaacacaggtgcagacatgttgaagaagttttgcaaaaccagaggatgcttctggaaggtgtgactacacaggtggcacataagaaatccagtctacagacatctgcaaagcaaattgaggacaggatttttgaagtgaagcatcagcataggaaggtggaaaaccagatcaaaatggccaagatggttctgatgaatgagctgaacaaacaggccaatgggctaatagaggaattagaggggattactaatgagagaaagcggaagctggaacagcagttacagagcatcatggttctcaaccgtcagtttgagcatgtgcagaatttcatcaactgggctgtctgcagcaaaaccagtgtcccttttcttttcagcaaagagctgattgtgtttcagatgcagcgattgctggagacaagttgtaacacagatcctggctccccttggagtatcagattcacctgggagcctaacttctggaccaagcagctagcttctcttggctgcataactactgaaggtggacaaatgtccagggcagatgctcctgcttatggaggcttacaggggtcatcacccttttatcaaagccaccagtctccagtggctcagcaagaggctcttagccacccctcacacaagttccagtctccagcagtgtgctcctcatctgtgtgctgctcccactgctccccagtctcgccttccctcaaaggccaggtccccccacccagcatacacccagcccacagcttcaggcagccccctgagatggtgccccagcagctggggtctctgcagtgctctgccctgctgcccagggagaaagagctggcctgcagccctcatccaccaaagctgctgcagccctggctggaaacccagccccccgtggagcaggagagcacatcccagcggctggggcagcagctgacttcccagcccgtgtgcattgtccccccacaggatgttcagcaaggagcccatgcccagcccaccttacagacaccctctatccaagtccagtttggccaccaccagaagctgaagctcagtcactttcagcagcagccacagcagcagctaccacctccaccaccacccctcccccatcccccacctccccttccccctcccccacagcagccacacccacctcttcctccatcccagcatctggcttctagtcagcacgagagccctcctggccctgcctgttctcagaacatggacataatgcatcacaagtttgagctggaggaaatgcagaaggacttggagcttcttctccaggctcaacagcccagcctgcaactgagtcagaccaaatctcctcagcatcttcagcaaaccattgtggggcagatcaactacatcgtgaggcagccagcacctgtccagtcccagagccaggaggagaccctgcaggctacagatgagcccccagcatctcagggctcaaagccggctctccctcttgacaagaatactgctgctgccttgccccaggcgtctggggaagaaacccctctcagtgtccccccagtggacagcaccatccagcactcctctccaaatgtggtgagaaagcactccacctcgctgagcatcatgggcttttccaacactctggagatggagttgtcatctaccaggttggagaggcccctagagccacagatccagagtgtgagcaacctgacagctggtgccccccaggcagtaccaagcctgctgagtgctccccccaaaatggtgtccagcctgacaagtgttcaaaaccaggccatgcccagcctgacaaccagtcacctacagactgtgcccagccttgtgcatagcacattccagtccatgcccaacctgataagtgactcccctcaggctatggcaagcctggcaagtgatcaccctcaggctgggcccagcctaatgtctggtcacacccaggctgtgccgagtctggcaacttgtcctctgcagagcatccctccagtttctgacatgcagccagaaactgggtccagctccagttctggccgaacttcagggagcctgtgtcccagagatggggctgatccctccctggagaatgctctgtgtaaggtaagtcctggggaaatgctatccaaacttcctttgttcatcattgggcaaaagattggccactgggacccttattctgaccttagcttaacagttctgagaccactaatgacaaccatgtctgagttctttgattcttgtcgacatttcacttttgaaagatggaaagtgaggattccactcgcttcactgacttactgggacaaggtcccatagtccccggtctggatgctcccaaggacttggccatcccctcagaactggaggagccaattaacctctctgtgaagaaacctccactggcgccagtggtcagcacgtctacagctctgcagcagtaccagaacccaaaagagtgtgagaattttgaacaaggagccctagagctggatgcaaaagagaaccagagcatcagagccttcaatagtgagcataagattccctatgtgcgactggagcgactcaagatctgtgctgcctcctcaggagagatgcctgtgttcaaactgaagccacagaagaatgatcaggatgggagcttcctgctgatcatcgagtgtggcactgagtcctccagcatgtccattaaggtcagccaggacagactgtctgaggccacccaggccccaggtctggagggaagaaaggtcactgtcacttctttggctgggcagcggccaccagaagtggagggcacatctcctgaagaacacagactcattcctcgaaccccaggagccaagaagggccccccagccccaatagagaatgaggacttctgtgctgtttgcctcaatggcggagagttactgtgctgtgaccgctgccccaaagtgttccacctctcctgccatgtgccagccttgctcagcttcccagggggagagtgggtgtgtaccttgtgccgcagcctgacccagcccgagatggagtacgactgtgagaatgcctgctataaccagcctggaatgcgggcatctcctggcctaagcatgtatgaccagaagaagtgtgagaagctggtattgtccttgtgctgcaataacctcagcctgcccttccatgaacctgtcagccccctggcccggcattattaccagattatcaagaggcccatggacctgtcaatcatccggaggaagctgcaaaagaaggacccagctcactataccaccccagaggaggtggtatcagatgtgcgcctcatgttctggaactgtgctaagttcaattatcctgactccgaggttgcagaggctggccgctgcctggaagtgttctttgagggctggttgaaggagatctacccggagaaacggtttgcccagccaaggcaggaggactcagactccgaggaggtgtctagtgagagtggatgttccactccccagggcttcccgtggcctccctacatgcaggagggcatccaacccaagaggcggcgacgacatatggagaatgaaagagcaaaaagaatgtcatttcgcctggccaacagcatctctcaggtgtgagagccaaaaggagactgggcactctggcagctgttgtcccatactgtcgaccattcctccccatcttgcagcttatcctcttcagagtgtggatggtagatgagtcttgttgaactgtgtagtgctcttctttgccatttgcatctacagcatttatttaggagccgtagtacatccactacagagaagatttcagtaataaacaggaaagaggaaggtatttattattaccagagtaatcagatgtataggctccacttgacaagaccacacctggttaggctcgggaaaacctactttccttggtgaatttttttctgcctgggaaagcagacccgtctaaccttttagtgtccagggctcaggagccatgtatacatctgaactcctcctgggctcagaagtgggtaaaagaagggagagaggtttagacatatggcaggactgtgatccctggcccagcacagccaaagactgtcactgtttgcctttgcttgtcctgtctggatagaggcacctgccatgtgcagactagtggaggcttctagaggccataggtctcaatttgtgcctatttgggttctaacggttttcagggtatttgttttgcatagtcactttcctgatgttgacataggtggctgctgtgaaaatgctgtggatggtgtgacattcttgactgagctgggtggctgtggagagaccacttaaatcttctggttcagatttcacttacagacttagtaagatgtccacttcagagcccgccctctgtgctacttactctgggctaatcacacttctttagggtgagaacctgccttcctagaagtgactgttggtgcttgtcagtggccatacccttcatcatcctcattcagaggtatggatcgtgagttctgcttgtgaatactgtgagacagctgctgtctgcttcaggtccagagttccatgggtggagagagtaacccacaaccagctcactcctctgggcctctcctcctgcttaaagattctagttctcaacctctccaagttcatgagccaaagatcagaagtgagtcttctgaccagcccgcctccaggctgtctacagccccaaaaaagccaacacttttctggcagccctttttgttggaggttagagaaggcctcagggaccaacaggggccagatctagacattcctgggggaagtttgtctaaggtggacagggggaaaaatcaagaggcaaaaagccagtgtcctttggtgaccatgaagcaacctcagagccttagttctcctagaatgcagagagaagcattctggaagccatgggaacaggagctcgaggctgcatcctgaatgcatctgcatggccctcgcagggtgtttgtgaggatactggaggtcaggctacctcccaagcaagggcttggttgagaaggaacccattgctcatattgttgggggagctatgaacctgacatgtcagtggccaggactgagacagctctccctggtcctgtcattgcatggctaatttcaggggagtctgaggtcatggctttatttttgctaacagatgaagttcaaggatgttcttgtttgtagggcctttgctaatgagcagttttttaattagaaaacatttcttctctctttgtgagttgatggtattgctcatttccttctctacccaacctgagagatcatcttcactttaaagcaaaccatgccccttggcttgccattctttcagcagcacatgccacgttctaagcagatgggcttccgtgatcccgttttctagtttggggtaactgagtcttgaatgctttactagtccggcaatctttggacttaggcttctgccctttgagactcacatgactttctggtttggggtctggtcatttccctttcaatttttgaatctccttctctgttcagttggcttggcaaagtaccctctgttctcatgtcactaattcctgctctaggtcatctttcctttgtgcagcccacattcccaccatcctgtgaactttgttgtacttggtgttgggcaactggtgagtgttgtgacaggctcagacctgatccttcctcaggagcaattggagaccacaaatttaaagcagaaatacctgttaaaagcttggctttccttatatgagtgaggctcccagcttgggtgtggcctcctgggctcacggatcagcttgctgggccagagggggtcttagtaatgtgctagagagacacatgctcccttctcatcgtagagagcctgcatgctgagaggctccctttacacacctgcctctcgctggcttttcctttagacctagccaccagtgttttgaatcatggttttgttttgtttttgcatgcaaaaaccagaacatgacttagaaatt

SEQ ID NO: 5 - DNA, 4101 bp, Homo sapiens
agagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagccccgacctctcccccgagctccaggcccgtatttccacctgcctactggacatctccacctggatgtcccacagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaacaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatcccgagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaacataaataaattaggtagtgtattttgagtggcatcagtctcactcatcttggtgccccggtgtttacaagagccagatggtgtcagaggagtacgcagttgtatgcagttatggttggggggaatgtttgtgagggtcttgaactatttatgagatgatcttgagcttctaattttcattgatgaaattgtggtggtttacagagactaagagctcattctgtcaacagaaacactaatctgtacagagcgctgtctcaggtcatgcattgtcctccaaacccaaaggtttttttcagggttggctagagagcgagtattgtgattttgctgaaaagacaaggtgtgaaggagcaacttcagttgacacaaaatttgaaatgctcacagatcagggaggtgatttcccaaagtaattgcccaagaacctccgttttggaaggattcctttttctgtagaatactttgcctcgatatataagcatacagatgcactttaaatgaaaacccttgattataaattgatagctggtagtgtttcttttgcaagaatgcatttctaaggcaaaaggtaaattattttgtccgtcttttgatgtactttctgattccaggattggatatttattcaaggactattttaaaaatagaaagtaagtttgtagcatgctgtctgaattctggggtaagttccacctcttctttagttgctttcgttttttatgatgtaggacttcctttgatatccctgttggaagtccattagcagtcctttgcatttgccaattcaaggtaaaacagggtcagtgacatctgcagtgtcccagtcatttatttgcatgaatctgcttaaataagttttttgttgctgttttttcttttttatgttttgttcagaatttgtacattcaagttgtacttgttatatctgacatgaatgaaataaaatcttaattac

SEQ ID NO: 6 - DNA, 3954 bp, Homo sapiens
agggtctgtgtcaagagcggcaggggctgcaggagataagagaaacgggctgccgtggggtgtgtgtaggcttcagagacatgggatcacggaagactgaagcagaaacagtggattaagacttcctgagcgatagctggcactgccttccccacaatggcagaggtggtggctgaggtggccgagatgccaacacagatgtcaccaggggcagtggagatgtcaacacctatgtcggcagagatgatggagatgtcaacagaagtgactgagatgacacctggggaggcccttgcctcatccctcttcttccagcatcaccagttcatgtgctctgagtgtggcagcctctataacacactggaggaagtcctctcacaccaggagcagcacatgcttgctgtctcagaggaggaggcactgaccacacagaatgttggcctggagccggagctggtgccgggtgctgaggggcccttccagtgtggtgaatgcagccagctcatcctctcccctggggagctcctggcccaccaggatgcccacctccgagagtctgcaaaccagatccaataccagtgctgggactgccaggagctgttcccctcgcccgagctgtgggtggctcatcgaaaggcccagcacctttctgctacggtagctgagccaccagtgccacctcctttgcctcccccaacaccactgcctccaccttctcccccatccgaagtcaagatggagccctatgagtgtcctgagtgctctaccctctgcgccacccctgaggagttcttggagcatcagggcacccactttgactccctagagaaagaggagcgcaatgggttggaggaggaggaagaggacgatgaggaggatgaagaagatgatgaagagatggaggatgaggaggccatggcagaggtcggtgatgatgctgtgggaggtgacgagtccacagctggctgggctcagggctgcggggactgtccccagcaccagccctcagcaggggctcgccggcaacaccggcggacggctcacagcccggcatctgccacccaccccttccactgcagccagtgtcagcgcagtttcagctccgccaaccggctgcaggctcatgggcgggcccatgttggtggcacacatgagtgtacaacctgctccaaggtcttcaagaaagcagcatcgcttgagcagcacttgcggctgcatcgcggggaagcccgctacctctgtgtagactgtggccgcggctttggcacagaactcacgttggtggctcaccggcgggcccacactgccaacccattgcatcgctgtcgttgcggcaagacgttcagcaacatgaccaagttcctctaccaccggcgcactcacgccggcaaaagcggggcacctcccacaggagcaacagctcccccagctccagcggagcccacccctccaccaccaccccctgccccacctgcccagctgccctgcccacagtgctccaagtcctttgcctcagcttcccggctgtcccggcaccggcgtgcagtacacgggccccctgaacggcgtcaccgctgtggggtttgtggcaagggcttcaagaagctgatccacgtgcgcaaccacctgcggacacacacgggtgagaggcccttccagtgccactcatgtggcaagacctttgcttctttggccaacctcagccgccaccagctgacccatacgggtgcacgtccctaccaatgcctggactgtggcaagcgcttcacacagagctccaacctgcagcagcaccggcggttgcacttgcggccagtcgcctttgcccgcgccccccgcctccccatcactggtctctacaacaagagtccctactactgcgggacttgtggccgctggttccgcgccatggcgggcttgcgactgcatcagcgggtccatgcccgagctcggactttgacgctacagcctcccagatcaccatctcctgccccacccccacctccagagcctcaacagactatcatgtgcacagagctgggggagaccatcgccatcattgagacatcccagccactggcgcttgaggacaccctgcagctgtgccaggctgcactgggggccagtgaagcaggcgggctcttgcagttggacacggccttcgtgtgacgcagctgaaaagcaacaacaaaagggtttggttgcaacagccagtgtgggtacctctggggagagaggacctcctctgacaaactggtctggtacccaccatgtgccaggatccaccctggcctctttttacccactgactccccagaacaacccttccaggcttctcttgtcatctttctctgcctgaggggaaactgaagctctgaaatgcgatgtgatctgtaccaggtcacccagctatgctgcaaagtgggttggccaaggccctttgcactgcatcaccctggtgcccagcaacatcaggtaaccttcactgagcaccaagcttatgccaggtctgtgctggccactctcatatacctcttcagatcctctgcttgtacccccagcccttgccttccctggattttgggcacccaggactttgctctgcctggtggagggtacttgatttctctgggcttccttcatctcaattctgacagtgtggaaggaaatctgtaggtacccaggtcctcagctccagactgggtgatgctggagacccaggagcaagtcagcacaggctctgcccacaggaggcatgcacaatctggtaggagaaacgcacaagtacagatagcttgctctctgagtgtgtctcattgattcattcagcctgtgtgtcctaaagcctcccttctcccatactgggtgatgctgggggcagagatgagtcaggcctaaggcttctctgggctgtgatggggatgtgcagggacagtgggatcccaggaaacagacctccatggtgggagatcaggagttaaggacttcctagagaaggtagtccctgaaggaaaagtaggaatctggcagtgaaagaggaaaagaacattccaggcagacagcactgcaagagggtgagctcttggtgtatttggagaccatccagttattcatctgactgcctacctgaggcaagcaccacacttaccactgtatgtgtactatgatcccaacaggcttgtgacatagatttcatattatccctgttgtatagatttttaaaactggtggctgggcgtggtggctcacgcctgtaatcccagcactttgggaggccgaggcgggcagatcacgaggtcgggagatcgagaccatcctggctaacacggtgaaaccccgtctctactaaaaatacaaaaaattggccaggagtggtggcgggcgcctgtggtggccagctactcaggaggctgaggcaggagaatggcgtgaacccgggaggcggagcttgcagtgagccgagatcgcgccactgcactccagcctgggcgacagagtgagactccctctcaaaagaaaataaaaataaaaataaactggccaggtgcggtggctcacgcttgcaatcccagtgctttgggagactgaggcaggaggatcacttaaggccaggagttcgagaccagcctgggcaacagcaagacctcatctctacaaaacttaaaagttagccaggcctggtggcacatgcctgtaatccgagtgctttgggaggctgaggcaggaggatcactcgagctcaagaattcaagacctgggcaagagagagagactttgtctctattaaaaataaaaatgattggccgagcatggtggtgcacaccagtattcccagctactctggaggctgaggcggaggcaggattgcttgatatgagggagattgaggctgcagtgagctgtgttcacaccactgcactccagtctgggcaacagtgcaagaccctgtcactt

SEQ ID NO: 7 - DNA, 2255 bp, Homo sapiens
tacggccgtcgtgccgctcgtgtcagtcaacatggaggcagaggaatcggagaaggccgcaacggagcaagagccgctggaagggacagaacagacactagatgcggaggaggagcaggaggaatccgaagaagcggcctgtggcagcaagaagcgggtagtgccaggtattgtgtacctgggccatatcccgccgcgcttccggcccctgcacgtccgcaaccttctcagcgcctatggcgaggtcggacgcgtcttctttcaggctgaggaccggttcgtgagacgcaagaagaaggcagcagcagctgccggaggaaaaaagcggtcctacaccaaggactacaccgagggatgggtggagttccgtgacaagcgcatagccaagcgcgtggcggccagtctacacaacacgcctatgggtgcccgcaggcgcagccccttccgttatgatctttggaacctcaagtacttgcaccgtttcacctggtcccacctcagcgagcacctcgcctttgagcgccaggtgcgcaggcagcgcttgagagcggaggttgctcaagccaagcgtgagaccgacttctatcttcaaagtgtggaacggggacaacgctttcttgcggccgatggggaccctgctcgcccagatggctcctggacatttgcccagcgtcctactgagcaggaactgagggcccgtaaagcagcacggccagggggacgtgaacgggctcgcctggcaactgcccaggacaaggcccgctccaacaaagggctcctggccaggatctttggagccccgccaccctcagagagcatggagggaccttcccttgtcagggactcctgagggcctgggtggccccttccatttcctggccctgctctgcttcctgtctacctcatactagaatgatcgtgactacccgggcagacattttactgtgtttctcagaccaagtgtctactgatggcccaaacatggagttttgtgggcttccactgtccccactccgaactcctgtatgtgcctggctgagtcacctaattcatactgtcatactagcataattatgactattgcatatgcttgttttgtttgactcttggctgcctacgtctgtagggtcccctgaaaatcccacttcctgcccccagaaagggcctttatttccaactaggaggataatgcctagtccaggcaatctttctctgtttagcagtcacaggtgagggtggtattagcatcttttttatgtagaaaaaattgagttaatggggtggactgggttgggaagaaatacatttcctaatgtatttatagaaaataaaaatatttttatgtgcctttttatttttgttggtggggaggtcattggacaagttccaactttcatcttgtgttcccttcaccttcatatcctgatcttagagcccccctccccctgccacccaccttactgtttaacctggatttttttttctatttaatttttgtctaatatcttagcccagtttatcaatcagttatcttaagtcagcattttctaagccattgtttgaggaaacagtgacaataggtaataacacatcttagtattaagagttttacaggccactagtataagataggcatcgtggtagatgcatataaagggtggaatgggagccatggcaggtcatagagtcctctcaatgggaacctgattgatgatcacagtcttcagtggtgagtcagtcctcaccaagttttccagatcattcctacaaagtaaactgggagaataataagtctgaaagagtgtggagtgctcccacaattacaaagaatgcttcctgggtggagtgttgagttggaaccattgtaaaggtgggcaaagcctagtagagaaccagtgcacctcaggtgcacttacatatggtggggctgaggcaaagcagccctgtaggcttcaaagaatcagtgtaagccactaaaaggaactgaaaacctaggtgtcacaataaacagtctacacagtctcacgtagaccaaaattctgatcattttccaggctgttgcatgaagtgatagagtatgattataatttctgtttgcttgtgctgtttgtttttgtttttcatctgtcaatgtgatgatctgtgttttatagggtagagtggatttgtctactttggctgtaaaataccctaatcacattatgatcttgacaggtgcactttactggggagaataaaaaggaccatacggtaaa

SEQ ID NO: 8 - DNA, 4713 bp, Homo sapiens
cggccgcggcgcgagccggagtccgccgagccggagcgcgacgaggccccgggcgcgccctccccgctgccgccaccgccgtgccgccgccatccgcccgccgccgccgccgctgtccggcccccgagcacgccggccccgcgcgcgcctcgaggccgagtcaaggtgtgagatgcacaatgcgaaacctaggccccagcttttacaccatgatgcgcagggttgtactttttgtactgaactgataggtggcctagtggttatgccctgtactaccattttgaggatctggactccgtttcctgccttgctctttggaccacattgtcaattcacaccgaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaatgt

SEQ ID NO: 9 - DNA, 5660 bp, Homo sapiens
gaggaggaggaggagcaggcgccgccatggccgccgctatcaccgacatggccgacctggaggagctctcccgcctgagccctctgccccccggcagcccgggttcggcggcgcggggccgggctgagccccccgaggaggaggaggaagaggaggaggaggaagaggaggcggaggccgaggcggtggcggcgctgctgctgaacggcggcagcggtgggggcggcggaggcggcggcggaggagtggggggcggcgaggcagagacgatgtcggagccgagccccgagagcgccagccaggccggggaggacgaagacgaggaggaggacgacgaggaggaggaagatgagagcagcagcagcggcgggggtgaggaggagagtagcgccgagagcctggtgggcagcagcggcgggagcagcagcgacgagacccgctcgttgagccccggcgccgccagcagcagcagcggggatggggacggcaaggagggcctggaggagcccaagggaccgcggggcagccagggcggcggcgggggcggcagcagtagcagcagcgtagtctccagcggcggcgacgagggctacgggactgggggaggcggaagcagcgcgacctccgggggccggcggggcagcttggagatgtcgtcggatggggaacccctgagccgcatggactcggaggacagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagaggtaaaaaataaataaatacataaaaagcaaacaagcggggacacctgcagtcttagtcactgacaatgggtttagggaaagttgcacattagagtcaaccccttcttttttttttttttttttttaaatccagtatttaggataatatttatgcttagtgtaaacattctgtgaatgaagtagactcttcggtggaatatattaatatattactgtatatccacattttcatggaatggtactgtgggagactgagcaaacactcttttggcaacttagtagaacagcttcttaaaggctttgcatgcttgctgctttaagctgcttttttttttcttttcttccctttagtgatttcagtagtttatattggaaagaaaaacaattacaacatgtgcccttacaaataccaaaagcactgtaaggatatttgtcttgacagtgtttattgatttgaagtcatattaggaaatatttagacaatgaaaattatcaagagataatttacctttcaattatgataaatagatgtgattggttgccatttgtgttcttttgcagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctgagtgctgacatcatgctgcaagtggaaaattccacgcctgacctcatgtgactggtcatagtcaaaacaattaagactttgtttcatgcacaaaattattaaaactgttgtataaaattaccttcagtctatgtgtataaggtgtttgtgagatataaatgaactttatgtttagtcttggatcgcatttctgagtctcattatgtatatgcagatactcaaaaatctgaaaaaaatcaaaaatctgaaatacttctggtcccaagcatttcggataagggatactcagcctgtctctggtcctttaagaaaaagttttcgattcctttgtctagttgacaaaaagtttggaaacataaacttagaccacacaacttgcattttaatatgacaatgttgatcttggtaataagccagtacattaaattttagtgaaagctgtttcatgtattttacagtaaatactgccatattaggtacctacaacaaatggtggtttttggaaacttttacggtgggtttttaaagttattaatagtccatcatttcatcatttgtgtttctgtatttattttgctaagaactaaataagattttgtacatcagattgtgtttgaaccgtaaggcacatctgctttatctaaaagaatcttaaggtggaaatagtgtaaaatttaaaattttttatatttctaataaactttttatatataaatgttacctaaagtggacacatgttacttctgaatttcacatgaaaggaaattaaagatggacaataattatctctcaatattttaagatttgttttactaattgaaaacagtatgtcagtaaatctttggccttagtgcttttttcccccttttacacattaataaaatgttttaaatatggtaatactcttaaaacggtagaatttgccacagttgtttaaagcatttttattttttctttgaattcttaattcatggtgaacagatgttgggttcttaaaatataaaaatgagaaaatatgtattaaaaatacttgatagagggttttctctttaatcacaacttaaaaaaagaaacctttaatacctctgcataagttctctgaaagaacttaaattcttagtttatatgaaaactgatatgtatgtctgtgtaacaaagcctgttgggtacaggtctacaaggagatactttgtttctaaaaaaggagttaaatcgtgtcacctgaattttttttttttgagataagtggacattttggggattttggttaaaacatatttctctattctaaaaattacagaatatgtattcataaaagggaagaaattgttagaaaatttcctgtgtacgtagtttgtttttaaattaaagaatcttgtgacctggtgtaggacattt

SEQ ID NO: 10 - DNA, 3512 bp, Homo sapiens
ggggaggggacaggcgctgcaaggagcagagccgcgggaagcaactccctaagccacaatgctagtcgcgaacacaggaaaaagctcatcccgccgccgcggggccccatgctcccgccggcaatgactatgcctgtgggagcaacggctaccggcgcgcggccttctgggagttgtttgttgcgcggagcgcgggcacgtccgccggccaccggaagcaccgccattggccggtgcgtgcaggtggcagccaagagcctcctggcacagcggcaccaggcaggtgacgcctattggaccccagaggtcatcccagctccagacgtggacacattttcttccaatgatgtctacggatgaggaaactgaggcctggagaggttaaagagacccgttcagagtcctacagtggcagactggtcttctgaggacctctgccctctacacagcggcctcttcaggtgcagggaggaaatggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcaatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcagtttgcgaggccgaggcaggtggatcacttgagcccaggagtttgaaaccagcctgggtaacatggcaaaatcctgtctttacaaaaaatacaaaaattagcctagcatggtggcgcatacctgtagtcctagctactcaggaggctgaggtgggaggatcacttgagcttgggaggcggtggttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagtaaaa

SEQ ID NO: 11 - DNA, 1308 bp, Homo sapiens
cctccgcctccattgaaggcggggaaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaaaaaaaaaaaaaaaaaa

SEQ ID NO: 12 - DNA, 9580 bp, Homo sapiens
cttggtcacatggtggcacggccgctgcgtcagtcacagccctggctgcaggagtccagctgccgtcgccgccgccagcggacggggcggggatcctggtgccaggtcttcgttaacccgcccccgccgcctcagtcagctgtcccagcccgggcccgaccgtcatggagcggtgcggggcctacgcctgttccgtgtgaggcgcatcgctgccgccgccgccgacgccgccttcgtttgtcgaggcctccggaacccccgccgcctcccggagcccctcgcccttggcagcctgtcaccgccccctgggcgggctcgaatgcgcgtccggtgaaggtgcaggcccggcgccgccactgccgcagccaggagatggttcgggcctagcggagccgggactggagcaacatgaaccgtgaagaccggaatgtgctgcgtatgaaagaacgggaaaggcggaatcaggaaattcagcagggcgaagacgccttcccacctagctctcctctctttgcagagccatacaaagttactagcaaagaagataagttatcaagtcgtattcagagtatgcttggaaactacgatgaaatgaaggatttcataggagacagatctataccaaagcttgttgcaattcccaagcctacagtaccaccatcagcagatgaaaaatctaacccaaatttctttgaacagagacatggaggctctcatcagagtagcaaatggactccagtaggacccgcacccagcacttctcagtctcagaaacggtcctcaggcttacagagtggacatagtagccagcggaccagcgcaggtagcagtagtggcactaacagtagtggtcagaggcacgaccgtgagtcatataacaatagtgggagcagtagccggaaaaaaggccagcatggatcagaacactccaaatcacgttcttccagccctggaaaaccccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccctcattgatgtcaaagtccaattcaatgttacagaaacccactgcctatgtgcggcccatggacggacaggagtccatggaaccaaagctgtcctctgagcactacagcagccaatcccatggcaacagcatgactgagctgaagcccagcagcaaagcacatctcaccaagctgaaaataccttcccaaccactggatgcatcagcttctggtgatgtgagctgtgtggatgaaatcctaaaagagatgacgcattcatggcctccccctctaacggctattcatacaccatgcaaaacagaaccttccaaatttccttttccaactaaggagtctcagcagtccaattttggcactggagaacaaaaaagatataatccttctaaaacttcaaatgggcaccagtctaaatctatgttaaaagatgacttaaaactaagcagcagtgaagacagtgatggggaacaggattgtgataagacaatgccgaggagtacaccaggaagtaactctgaaccttcacaccataatagtgaaggagcagataactccagggatgattctagtagccacagtggatctgaaagcagctctggatctgactcagagagtgaaagtagttccagtgacagtgaggcaaatgagccatcccagagtgcatctcccgagcctgaacccccgccaacaaacaaatggcaacttgataattggctgaataaagtgaacccacataaagtgtcacccgcctcttcagtggacagtaacatcccatcatctcaaggctacaaaaaggaaggccgagagcagggcactgggaatagctacactgatacaagtggacctaaagaaacgagttccgctactccgggacgagactccaaaaccatccaaaagggatcagaaagtgggcgtgggaggcagaaatctcctgcacagagtgacagcacaacacagagaagaactgtaggcaaaaaacaacccaaaaaggctgagaaggcagctgctgaagagcctcgtggaggcctgaagatagaaagtgaaacccctgtagacttggctagcagcatgccctccagcagacacaaagcagccaccaaaggctcaaggaaacccaatataaagaaggagtctaagtcttcccctcgacctacagcagagaaaaagaaatataagtcaacaagtaaatcttcccagaaatcaagggaaatcatagaaacagatacctcatcctcagattcagatgaaagtgagagccttcctccttcctcacaaactcctaagtaccccgagagcaataggactcctgttaaaccctcctcagtggaggaagaagatagcttttttcggcaacgaatgttctctcctatggaagagaaggaacttctttcacccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataagaatgaagatgataaccgagccagtgagagcaagaaacccaaaacggaggacaagaattcagcaggccataagccatccagcaacagagagtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggaaaaggctccaagtagctcctctaactgtcctccatctgcaccaactcttgattcttctaagcctcggagaacaaagcttgtctttgatgacagaaattattcagcagaccattatttacaagaagcaaaaaagctaaagcacaatgcagatgcattgtctgataggtttgagaaagctgtatactatcttgatgctgtggtatctttcattgaatgtgggaatgcattagagaagaatgctcaggaatccaaatccccattccctatgtattcagagacggtggatctcatcaaatacactatgaagctaaagaattacttggcaccagatgctacagctgcagataaacgactcacagtactttgcctgcgatgcgagtctttgctgtacctgaggctgttcaaactgaagaaggaaaatgctctgaagtactcaaagacactgacagagcacctgaagaattcttataataattctcaagcaccatcgcctggcttgggaagcaaagctgtggggatgccttcccctgtttctccaaagctgtcaccaggcaattcaggaaattattcatctggggccagtagtgcttctgcaagtggttcttcagtgaccattccacagaagatccaccagatggcagccagctatgttcaggtcacatccaacttcctctatgccaccgaaatttgggaccaagctgaacagctttccaaagagcaaaaagaattctttgctgaactggataaagtaatgggccctctcatctttaatgcaagcatcatgacagatctagttcgttatacccggcagggactgcactggcttcgccaggatgccaagttgatatcttgaactgaacacattctcgttgcctctgattttctccacaacactgtgtcacatcacgaaggaaaactgccataacataccacctagtcgacactaagaatgaggaatagttttctcctcgttggttcatgtgttgttgtttttgataatccaaagcgatcatgtcagttggccctttaatatttccaatgtgaaagattatttaaatgcttttaaatctgcagcacattgataagatggtttccgtgagctatgataagattgaaattccagttgcaattcataactaatgaattgaaattttatttattttaatttttttaagttcccagattggggctagtttaagacttagttatttctgcctataaatttactctgttgaatatttagcataaatttaatgtagacatttttatttatataccttgggagctttattacctaatatctttttgtggtagctgttctaagagtaagaattggttcgtctaaaataaggacatattctttctacacctgctacctgacctgatatttgaaatcttaactccaattttattattgtggaatttacagttagtattaaggatattcttctacacatgaaaaaatcacttaaatatgagaaaatggcattctacatgtatgtactatgaaatgtgtctgatttggtatgcattatttcaaaaactgtgaatgtgtgttaataacactacagcaatcacacagtgactatagcttgcatttaatgcattacaaaagagggaggacaaactttctagaagaagcatttcatgttgaagggtttcataaaaggacaatcctgaacgttacggattttattaaaaccatatgttattttttgttgctaatcatttgacacttaatcgaaacagaataagttactgtggaaaaaaggatgatccaactcctgaggattgccgcctgtgtgtctttaattgattatctttgatagttagagttatttttcagatttttccccctcatactggattgtgatgctctgatatgagcatgcaatgactgatacagaaataggctggagcttcggtgtgtgcttttgctatacagcttacagttctaatgcctgatgtagagatgatgaatttctcctttttaaacctatcttctgtttactccttttgcattatgaaggccctcttcaatgatgtatgtttctgatggaatcagaaaatttcacactagaaaagtgtacctaacttgattcagtgtgagctcttgggacagggagtggagccaggggtagagcttaaagaagctggctctgtaagagttgtatatcaaagtaccttttgctacaaggtgcatatagaagtctaagataagaaatgtaccctctatactttatttttcatgcccctatcatgtttggtgtgccttaaatcttacctttaaatgaagactctatggattgtttacaaatgaagttttacactaggaccagatcgtccatacatgattggtcttctacaataataatgttcaattctttcattttaaatctttctttagggtcatataaagattagttctttcagaaaagctattgctttggtacatgacttagtctaaccagttgggtaatgctgctttgaaaaatagtttgtccctctccccattccaaaaatgaatccattcagtcagaaaaaaagattatcctactatttgtagatgattgctaaggcttgaaataggaaaggggaaagaagggatagaaaagtttcaagtccagtagtgcagtgaatcctttgtgtttgagacttttttacacttatttctgaagttagtgaactttcattgtccctgtggcctcatatttatagagcttcttaactgttttgtacctcagattgtttttagatgtcattgaagattgagatgtacaaattatgttgaatttaacctgtttctcttggagaaattgcctctgatatctttctaacttaatcttagtgtgttctaggaacagttttccataagaggacaacttctcaatgatcatgatagttatttagtaagaaataatggttgttaatcaaatacatgttatgtcttgtccttctctgatttttctgacttggattccttaatttgcagtgatgtcttagaaatggaaaaagtatcctctgggctttcagactttcagcaacaacagccagtgggatacctctgagttcttgtgttctagtctcttgtatgtcctgaaaggcagcaggagcatttttggggtcacactgatattttgttaaagcagagtttcctgcatggtttatggtgctgctctaatattttctctttaaaactgtgtcaatttttggagaatgaatttttcaaccttttcattgtggaggatttttcccacaaggtagtaatgggcaatggatcaaaatcctatcataaatgattgaattttcaatgtcatagtgtgtggaaatactactccctttcctccatgtctatcttcttagatgttctgtctttgtcatcatctgctccagcacatactttggactcctttacaggtgaccttcccccctccctcctcaataggtgtcctcagtgttttctaagcatttaaaactgaatttgacaagtggctaaaaacttagtctgagacttgtacttagtatatggttaattatagaaacaacaactattttaaacagttactctgttgactgctctttatgactacacttgtatgccaggaggcagcagcctatacaccattagactctttacaagcaaccaacgaaccaattgcagtggttgcagttgtcacagtagtcttgcctgggccagactgggctgggctgtgggaagcattccccttcaggggagtttccacagctcagcccaggctccagtctggctagagagcatccagcccattccttgcctcagtgccacctttttctgggcaagtagccaagaagtgactttatatgcagtgagtacttcagataaacttacagctacagctgccgaagagtggagaaggttgaccaccatttatttaattctctagtgtaaaaacaattgagagcagtgtgcgtgagcccacagacacctgtgtttctgggagctctggcagtggcggattcataggcacttgggctgcactttgaatgacacacttggctttattagattcactagtttttaaaaaattgttgttcgtttcttttcattaaaggtttaatcagacagatcagacagcataattttgtatttaatgacagaaacgttggtacatttcttcatgaatgagcttgcattctgaagcaagagcctacaaaaggcacttgttataaatgaaagttctggctctagaggccagtactctggagtttcagagcagccagtgattgttccagtcagtgatgcctagttatatagaggaggagtacactgtgcactcttctaggtgtaagggtatgcaactttggatcttaaaattctgtacacatacacactttatatatatgtatgtatgtatgaaaacatgaaattagtttgtcaaatatgtgtgtgtttagtattttagcttagtgcaactatttccacattatttattaaattgatctaagacactttcttgttgacaccttgaatattaatgttcaagggtgcaatgtgtattcctttagattgttaaagcttaattactatgatttgtagtaaattaacttttaaaatgtatttgagcccttctgtagtgtcgtagggctcttacagggtgggaaagattttaattttccagttgctaattgaacagtatggcctcattatatattttgatttataggagtttgtgtctgggtcccaggaacatctactggggatgactgttaggcagcttgtgatgatgttttttaaaaaacctaagtaacttggggagacagagcatttcaaacccatatagacacctatcatacctgtatatcccctaatacatggaacataaatttcatttcagctttatgcattaatgtattgaagaggcaggctttttttccagtaataatactgtacatctaaggttgctattcagtaaaactaatagaagagataattattgaataccttggaatatgtagtgagaagaggccaaatttttcatgtttgtgagcatgtctttcagatactcgctaatggagaaattcactttagacctctagaccccaaaaccaagttagcaagtgacaaaaagtaaattattaatagtctgtaaagtggatgctggtcttacaaagctcctattcacatgaaccctatggttaattagaaagaacttgctgtctccagaaaagggaatggaaataataactatgtatcttcttttcatgtaatttggtcacagaataaggtattcaagttaagtctaatccaagtcttagagatctttaagtatcctaaaatagcagcctaagtagtcatcatgtaaagaagttgactttcaggaatgtcagcattgacctctccttgccactgttactcagctaaacataacttgccattcttaaaaataaaaaagctcccacccagaaactctagtgatactcagttttgacctcttactgcttccatgtgggacttcttttcagcttttaaccattggaattttctacctgctatgttcctctctggaaaatatcaatttggaaatgctgcctttcaaatcaatgccatgatcatccatattgttgagtttgttgttggtgttccagaagtgtccccattttacaactttatgcacacacctggcaaatcattaacatgagcattcaacagtactgggatgggtggggtgggggtagggggctcaccaacagaactggccagttgacattgcctgaaaaggcaccacctttaagggccagttgtggggttggtaagcacagttatgaaaatttctatctagcctccgttttgaatggttttaagaaattttgtatatggaggatggaaatgcttatatatttattgaaaatccttttatttgaaattaaaattatttggtatataattgtttgatatttggggagggttttggaggggagataatgtcactgataaattaaaagcctgttgattttgcagaaaggtactgttagtgactgataaggatgcctttgttttgtacatgaaccaaatctttgttttacatttcttttatccaaaatatttaggcatctgacattttcaaccagaatttcaattatatactgtgatttttatttgttgcaatacattacaatttcagaggtactttggggctcaaaagctaggatttctaagtcagtatgtgcatttcacacgataaagctgttaatggtgagcaaagtattatatactaactagatttttccacatctgtatagtatattatatgtattttgtggtattgagagtatagaaagtttagagtgtcaaacatgcgtttaatgtgtatttttaaacaaatttatggcaattaaaatatttggagacaagggtatcacatttcaatttgtaaagatctttttaactctactgtgtcattaagatgctttgtacaatgccaaaccatagttggagaaactaagtttaataaatatcaaatagattttctgtattaaagttactgaacactgta

SEQ ID NO: 13 - DNA, 6247 bp, Homo sapiens
agtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactctgccgcccaaactggagtgcagtggcacaatcttggctcactgcaacctctacctcctgggttcaagtgattctcttgcctcagcctcccgagttgctgggattacaggcatgtgccaccatgcccagctaatttttgtatttttagtagaaacgggtttcaccatgttggccagactggtctcaaactcctgacctcaggtgagcctcccaccttggcctcccaaagtgctgggattacaggcgtgagccactgcattcagctcttcttttctttagatatgagagctgaagagcttagacacattttgcatgtattatttgaaaatctgatggaatcccaaactgagatgtattaaaatacaatttttggccgggtgcagtggctcacgcctgtaatcccagcacttggggagggcgaggagggtggatcacgaggtcaagagatggagaccatcctgaccaacatggtgaaaccctgtctctactaaaaatacagaaattagctgggcatggtggcgtgagcctgtagtcctagctactcaggaggctgaggcaggagaatagcctgaacctgggaatcggaggttgcagagccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaatttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaataat

SEQ ID NO: 14 - DNA, 5661 bp, Homo sapiens
ggcacgtggactccctttaatccagtgactgtcaggtcgatcatatgccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtcgtgcaggagcagagctcacggcagcctgcggccggcgccccctcgcccggagacagctgtcctcttgcagggtctgccgtgctggagggaaggctgctgttggagtctcttaatggctttgctctggtcgtgagtgcagaagggacgatattttatgcatcagcaacgatcgtggactatctgggcttccatcagacggatgtaatgcaccagaacatttatgactacatccacgtggacgaccgccaggacttctgccggcagctccactgggccatggaccctccccaggtggtgtttgggcagcccccgcccttggagacaggagatgatgctatcctggggaggctgctcagggcccaggagtggggcacaggcacgcccaccgagtactcggccttcctgacccgctgcttcatctgccgtgtgcgctgcctgctggacagcacctcgggcttcctggcccgggggtcacaggcttggcagctgcggctctgctgtcccgagccactcatgacgatgcagtttcaaggaaaactaaaattcctgtttggacagaagaagaaggcgccgtcaggagccatgctcccgccgcggctgtcgctgttctgcattgcggcacccgttctcctcccctccgcagcggagatgaaaatgaggagcgcgctcctgagggcaaaacccagagcagacaccgcagccaccgcggatgcaaaagtaaaagccaccaccagtctgtgcgaatcggaactgcatggaaaacccaattactcagcaggaaggagcagcagagagagcggcgttttggtgctcagggaacagactgacgctggccgatgggcacaggttcccgccagggccccatgcctgtgcctccggggtggccctgaccttgtccttgaccccaaggggggctcaggggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctcagatctgtgtgtctacgctcagatgcgtcggtggctgggctgccctgctcctggtcaggccggagcccgtcctaagacacacgctttgcagagctgtgcatgcgcagtctgctagtgtgtgtgtgcagcatacgcaggagcctatcctgaattttgtaaaatatcccaacagttcttaaatgaaaactggccttaagtctattcaagcatgacagcatttctctttgaggaattaaaatctttaggaaagtgatcatggctggacagcttcatgccccagaggcagcgagcacccgtcccatggctgccaagtccacagtcggggatgaagcagtcgggtgatgctcccaagtccgcagtcggggatgaagcggtcgggtgatgctcccaagtccgcagtcggggatgaagcggtcgggtgacacacctagctcagccctcccaggccacctgcagctcccagcctgtgctgtgcaggcagggtcagcccatcgccacagtgcactgtagaggccagcacacggcaaattagaaatacaacacgcggagaaaggggtccgtgagcccactcatagaggaatctagaacgttccaggcagcagaggctggcagcgtgggtcccacactgccccacaccgtgcggcaggtgctccatggcgccatgacagagtctgaggccagacctggactggaattgacagcataacccctgttccttctggacatctcccgagttctcagtgggtctctgcggacggttcttcctaatctgcctcttggtacatcacgtaatacagagttcacagactccgggtttggaagtacagagaaacacacaacgtagagagaagacacaggaaactgcgctgcctgtgggggtttctctctggctggctgtacagttcactcaaatgagggttcccattgccatcctaggagaataattagggacaagacagacaagtattaatagcattaaaacagttgtaaaggcgatattttctgagagtaggaaatttggatacaaaagcataagtcagaaagtgaaggtcaccaatccaccaacccgagaacctacagctgatggtgcatttcaggcttcttccacggtctggcctggaaccccacccggctggtgcaggcatcagatcagggtgtagaagtcaccccaagcaagaggaagccaggcagtgaggccctggggtgtggctgcagctgggcccacctgtgcgggggtgggaaggccccatcctcagggagagggcatcggcgccctgacgtcagctccactgggagtggcaggagctgtgggagcccatgggtgagggacccaccaccccgctgcactgtgcattgtgcctcccgtgtggacgccctctctgttgttggcccgcgggtgagggacccaccacccctagggacccaccaccccgccgcactgtgcattctgcctcctgtgtggacgccctctctgttgtcagtggctttgaggtgtcagtgcttacttagatgctggtttaatgctggacccatttgttaaacgcaccttcactttgtcaaaacccaggtttggttggcaggactgggtcttctgcccaatgccaggtgcctgcgcctctcagtggcctggttcttggacagtttgcccccatgtggcagggatagggataaggatctcctctcagtactggaagagaacagccaaccatctgagcccagagtcacagatccatcgtggccccctatgacccccaagccctaccgagggggcactcactctctgcttagccagggggcgtctttcaaaaggtgacctccatgctgtgctgtcgtgggtgtgagacgtgctcatggccttccactgccatctctcccttatctgatgcctaaagtcacgatggggacagagctacccaggggccagccatggggtgaccagccacctgagggtcagtcacctgtggagagcaggcacctgtgaagaccaggcacctgaggactggcgcctacttcccactttggccctacactggcacagagcccctctttattcatttctcatgctgagcatggcacacttctggcctctgggcatttatggatttaagaccaggatggtatttcagaagcttcccacttccttcctattctaaccgagtgcccagctcctttgctgatcatggaaagacccttaataattaggcctgcaggccaggcgcagtggctcatgcctataatcccagcactttaggaggtcaaggtaggaggatcgcttaagcccaggagttcaagaccagcctgggcaacacaggaagaatgtgtctctacaaaaaataattaaaaatcagatctgctgtatccctgaaaaagtctcaatcaacatgcatgttccactcttggagttccctgttctgagggccagccacgtcctgtgtcctggagcttagccctcagcagctcccttcagcctgggcgccgcctgggtcccaaacgtggcagctgctcttccagtctcggggccgaggagggcagggagctcagtgactgagagtcttgtgtatcacatgtcttgagtgtcctggagccaacggctgtcactgggaaaaacaccaggccccaaagatcgaatcagagacgtggctgcgtgtttgcgattgtagccaggcccttcagtgtcatcaaaggagcactggggcctccttaagcacagacggcagcccctgcccaggaggcttcttcaccacgtcctgccctgcagcctcccagacctttagatgcgcccctgcccaaggccctcctggtgacaggtgccagattgagtggtgggttgctgccaggcaggccacgctgtgttgacgctgcactcagcacgtgggtgttggctctgccggttttgtggtgtggggaccctacaggaggctgcggccctgagagcctgggatcagcgaggtgtccgacatcccttcctcaacggcaacaaaaactccccaagtcagcactttggttattttatagccacaaccctcttggaaaacagtggggaagactatggaacatagaaagtgtggatgtatcacttctctctaaaatgtcattgttagcactaattacaggttcatgtttttctgtgtatgtagcttttccctatatagctgaaaaagtattaaagtcaaatataaggtgggaatgggatggaagggaggagatcaatacaacttatatttttgcagtttctactggaagaaaaaagttttcaatacctagaccaacttgttgaatttttaaaacttatgcactataaatgcaactttctctactgctttctcagtgcctttaggaagctttcaaatttttttgtactgtggtttgtattaaatttgcaatattgatgtaaaatacatgacatgctagtacatgtttaacaaaaatttaaa

SEQ ID NO: 15 - DNA, 429 bp, Homo sapiens
ttttttttttatttttatcaacccacatctttattcttccctcactcacctccattccccatgaaaaaaaggaacttttggcccaaagtgcatcaaaattatgattatgagaagtggcaagaaaaagatgtctttcttatagatgttcttttctgaagactctgacagagccaggattcatgttcttctggcctctgacctgcaaaatgctgtaggtgtggccaggtctctaggagatagcacagagaccagagcaagggacatcccacgctagttatctggggatggaaggatgccctaacaggaaatgtaaaggcacacaatgtattcttcttttgggctcctcatggttttcctaatcctctacccctataagatcagatttttggtatcaggatggtggggtgacattttgttttatagtataaa

SEQ ID NO: 16 - DNA, 392 bp, Homo sapiens
gagacggagtctcgctgtgtctcccaggctggagtgcagtggcagagtgagactcctcaaaaaaaaaaaaaaagttcttgaataaagaaggattattcttccaagaatccaacgtagctgagtaccttgtaacaagtgcagtccacttactgttatactcaaagacaagtttgtatattgattggttctttcaaattcttcacctcagtttcttcttgagtacttgtagaaagaatgatgatactgatggctattttgatttcttttttacgttcttttctcgtttcatttctggaaatatttagtaattaaatgtattatatgttaaagtctgttaacttatactgagctatgttaagaaattatttccaatgtgtttgtaccaacaggtt

SEQ ID NO: 17 - DNA, 122 bp, Homo sapiens
caacaaaacaggaatggattttgtgtgggtagaacagcactgtggtcgaatcaggaaatctgggcccacctttatgatgtagatgctggaatgaacaagccacttggcccccaaacccagcc

SEQ ID NO: 18 - DNA, 2257 bp, Homo sapiens
agacgggcgggcgcacagccggcgcggaggccccacagccccgccgggacccgaggccaagcgaggggctgccagtgtcccgggacccaccgcgtccgccccagccccgggtccccgcgcccaccccatggcgacggacgcggcgctacgccggcttctgaggctgcaccgcacggagatcgcggtggccgtggacagcgccttcccactgctgcacgcgctggctgaccacgacgtggtccccgaggacaagtttcaggagacgcttcatctgaaggaaaaggagggctgcccccaggccttccacgccctcctgtcctggctgctgacccaggactccacagccatcctggacttctggagggtgctgttcaaggactacaacctggagcgctatggccggctgcagcccatcctggacagcttccccaaagatgtggacctcagccagccccggaaggggaggaagcccccggccgtccccaaggctttggtaccgccacccagactccccaccaagaggaaggcctcagaagaggctcgagctgccgcgccagcagccctgactccaaggggcaccgccagcccaggctctcaactgaaggccaagccccccaagaagccggagagcagcgcagagcagcagcgccttccactcgggaacgggattcagaccatgtcagcttcagtccagagagctgtggccatgtcctccggggacgtcccgggagcccgaggggccgtggaggggatcctcatccagcaggtgtttgagtcaggcggctccaagaagtgcatccaggttggcggggagttctacactcccagcaagttcgaagactccggcagtgggaagaacaaggcccgcagcagcagtggcccgaagcctctggttcgagccaagggagcccagggcgctgcccccggtggaggtgaggctaggctgggccagcagggcagcgttcccgcccctctggccctccccagtgacccccagctccaccagaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaacaaaaaaaccacataacataaatttatcatctcgaccacttttcagttcagtggcattcacatctcatgtaa

SEQ ID NO: 19 - DNA, 2759 bp, Homo sapiens
agtttcagccgcgacagcaagaacggcagagccggcgaccgcggcggcggcgacggcggaggcaggagcagcctgggcgggtcgcagggtctccgcgggcgcaggaaggcgagcagagcacaaatgaggatgtcccaatttctgccttttgggttttaccagctgctgtaggttttccacactgagtagttgcagtagactggctgccctctgtccaacatgcaatgccacttggtatcattcatggtttgatcccgagaacaatccacctattatataattttcccctcacatgtcattccactgacctcaatcaactgatgtggtgatgaaatgaaacacgttcatggagaagctgagaaaagtgtgcaaagtacacctacaaggagagtttccccatgttttccataatgtggccatccaggatgaggaaggaacaagaatacttgaacatcacagagaccaaaccatttccatacgtcaaaaccagagagcctgggatcaaagttatacttggaaaagggctgtaagaaatgaaaaaccacctagcagcatctgtacttcccttaaaatccaacctccactggcttcctctgaatccatcagggtcttaaatatttaaagaaaggctaaattcagaaggtatttaagaaatgggcaggccctgctgggtcctgatgagtccagtgcctccgggagctgcccaatgggccagcagtctctgtggaatccaggtgacccttcccactagggattggaccaacacttcacgcagctttcttccgaggaccccaacgaaggagtgatttgaacccaagtcaaaagggtgccctacaaggctagtttgaacagaacccctaccctgatgtgactcccagagaacaactgaccagagaaattggcactccagaatttagaatacagatgtggtttcgaaaccagagaacacaacacctcagacagagtctactggggtctggattggggtcgatttcctggaattgctatcagggaagaactggctgcacaaacaggcctctcagagtccagaactcagatatggtttcataaccaaagagctcggcactgtggccagagttgtagacttgtgaattccctggcagaaggccccaagtcggagacctcacatgactgtgtgacaaggcaaggcaacttgtgcatggcccctagcagtggggtcacttccctccctccagttctttcagcaacaaccagctcttcttccacctcacacatgctttggttcttgggttccccctgggctcggagtgagccaggcaccaagggtcatgatgctccacccaccaggctgtgctgggaggagagatctctccacctcttctgacacttaggagtcacatgtcaacaggcccagctctaggaggggcgctcttacatcctctggctcctttccagcccccacaccaaggaagatgccaggatgacaaggacagagacacatggcctggcagtactgccctgtaaggactctacacagccccaacctggcaatcctaagcaccagttgcagggaactggtcagcaagacacatctcaccttatgcagtggtggcacaaggggccccaaggagtgatgtcaaatggccagctggagcaggggcacttcagcagcccacagagcctgcacacacctggacatccctgtggcagtagcgggcaccaccagctgcagagccatctcagccactcgagcaaccgcacagctctctgcaaaacccacccttttaggtcaatgcctgtcaattgtatagtttcagaaaaagacacaagcctgcctgaatccaagtccacaggaaaaggtccctctaccacttgaaccacctctcagtgaggaagaatttgatgctctgcctgatgtgatgcagacctcaccagggtgtcagctttgggaggagcaaggcctccttctcacctccaccatctaggccactttcctggacacagaatcaatgtgataccaagaaggacaaacaatgcacacactgtgtttggcagcaagaccaatgcgagaaaaagcaccaaacacttagaaacccaaagggagcattttgactcagtcttgtgggaggcgcttgacttctcctctcacttaatggcctatatgattgttgcaaagctctctactgcccctgtaaggcatcatgggcaccaagccatgaatgccttcactgcatcctgaagaaccaaagcatttttatagcaaacatcacctactccctgcaatcctcaccgcttgggcagtctggactatacaggaactggaaccaaaccaaaccagggcgaggacactaggtctaagggggacagctccacacttctttccttctggcaagttcagaagtcacacctgaaagcaggtagatgtctagaatatagagggatgctgtattttcttgttctgtgagttgataacaaggagtttttaatctcagctctgagagttgcaaatgggaattggaagtcacttcactacccacctcttgggaactgattccacaagtttatatccataatcccgagtaggcttcatgaccagttttccctctgaacattgaaatgtagagaaaatgacagaagttagaatagcaactcccttagatcattgaacaaagcatatgaatgttactcttctcacattgttagcatttctgtatgttaacctgtacttctacccatcaagctgccctttttattataaataaatgtcaagtttaaat

SEQ ID NO: 20 - DNA, 2918 bp, Homo sapiens
gggtgtgtctgcggaacctccacctgagctgtagagtgtttccctcgacccactagtctgggttccacagggtctgagctcctcagaggtgggagctgcggccgagggaagggtgcatgtgcgcggcgacaatcaggcctcttccccaggcagcttgtgagcccctctccctctccgccctcgcccaggctgctccgatcttcgtttccttgcctaggctcatacacccaggctttatttagggccaaagtatccgtcataacctcggttttctgtctcgcaagtatcttgccgctcaatttgtgaccctgaagctttagtgagtcgctctgtgctcactatttctggtcttttcagaggatggcttcactttcaatggaattgcccgagtaactgccctgtgttgtcacgtaaacaagtccttttaaactgagtctgtagttgtcctgtgttgagtgttttcttatatcaaaaactttcctgaccaagaacaaaaaaggagctcaagtaaaatcacccatttgactagaccccaactggagagaacctttgcctgagctgtctaagctcgggatggaagcagtctctagggtcttcccagccttggctggccaggctccagaagaacaaggggagattatcaaagtaaaggttaaagaagaagaccacacttgggatcaggaatcagccctacgtaggaatttgtcttataccagggaactctctcgtcagcgcttcaggcagttctgctatcaggagacacctgggcccagggaggctctgagtcaactgcgggaactttgccgtcagtggctgaacccagagatacataccaaggagcagatcctggaattgttggtgctggagcagttcctgaccatcctgcctgaggagctccagtcttgggtgcgggagcataatcctgagagtggagaagaggtggtgactttgctggaagatttggagagggagcttgatgaacctagacagcaggtctcacagggcacatatgggcaggaagtttctatggaagaaatgatccctctggattctgcaaaggagtctttaggcacccagcttcagtctatggaagatagaatggaatgtgaatctccagagccacacccacttcaagataatgggtcatttttgtggttttccatgatgtctcaaagcatgggtggtgataacctcagtagcttagatactaatgaagcagaaattgaaccagaaaacatgagagaaaagttcttcagaagcttagcaaggttactggaaaacaaaagtaataatactaagatattttctaaagcaaagtactgtcagttgataaaggaagtgaaagaagctaaagctaaggcgaaaaaggaatcagttgactaccgtcgcttggctagatttgatgttatccttgtacaaggaaatgagaagctaattgaggctgtaaatggggaaacagataaaatacggtattacttacacagtgaggacttatttgacattctgcataatacacatctcagcattggacatggtggacgtactcgcatggagaaagagttacaagcgaaatacaagaacatcacaaaagaagttataatgctgtatctgaccctctgtaaaccatgccaacagaaaaattcaaaactcaagaaggttctaacatcaaaatcaattaaggaagttagttcaagatgccaagtagatcttatagacatgcagttgaatcctgatggggagtacagatttattttgcattatcaagatctctgtacaaagttaacttttttacggtcattaaagtctaaaaggcctacggaagttgcacatgctcttttagatatatttacaattattggagcacccagtgtcctacaatctgacaatgggagggaattttcaagccaggttgtcagtgaactcagtaatatttggccagaattgaaaattgtccatgggaagtctcagacctgccaaagccagagttctgcagaacaaactgaggatatccgaaagaggattttctcctggatgcaaactaacaactcatcacactggactgaatttttgtggttcattcagatgtcccaaaatcagccctatcacagaagcatgcaacagactccatgtgaaagtgcatttagctctgaagctaaactgggcttgtcccattctcagctaactgaagaacttgttgccagcttgcatacagaaaatgaattagatcaggctgacaaagagttagaaaatactttaagagcccagtatgaagaaaacattgagactggaacagacagtagtgatattgaagagaatctttctgtcactcctaaggtggctgaaaaaagccctcctgagagcagactaagatttttatcctgtgtagtttgtgaaaaagaatgcacaggtgttaatagttgtatatcatgtgatggaaatatccatgcaatttgtggagtgccctctcaacatgggactgagggctgtggtcggcaaataacttgtagcctttgctatgaaaccagcacaatgaaaaggaaacatgatgagattcaaagaagtttgcctgttaaaccttccaaaatgctaaagccatcagggacaccattttcaccagacaaagtaggagattggatggcgaaacaagcttcactggacttttttgtcaagaaaagacatgccttttctgaacacagtagtagtaataaaagaaatgttaacaatagaagttatcctgaagaagggaaaaccaaaagagttcatgctagtttcactcggaaatatgatccttcatatattgagtttggttttgtagctgtaattgatggtgaagtactaaaaccacagtgtattatttgtggagatgtactggctaatgaagcaatgaaaccatcaaaacttaagcgacatttatattc

SEQ ID NO: 21 - DNA, 1506 bp, Homo sapiens
aaagggacacggtgtccgagtctttaggtctgcgcgggagccgaggctgcgcacctgggctgaacctccacagtcctctacactcttccaggagcagcagaaaatgaacatgtctcaggcatcagtgtcattccaggacgtgactgtggaattcacccgggaggagtggcagcacctgggccctgtcgagaggacgctgtacagagatgtgatgctggagaactacagccacctcatctcagtgggatattgcattactaaacccaaggtgatctccaagttggagaaaggagaagagccatggtctttagaagatgaattcctgaaccagaggtacccaggatattttaaagttgatcacatcaaagggatccgggaaaaacaagaaaaacctctgtggcaagaaatattcatcagtgatgctgacaaaacattgagtaaagaaggacagaaagttttagaaaaaccatttaatctggaaatagctccagagctttcagaaaaaatatcctgtaaatgtgactcacacagaatgaatttgccagttgcttctcaattaattataagtgaaagaaaatattcaagaaagaagactgaatacatgaatgtgtgtgagaaactgcagcttgatattaagcatgagaaagctcatgctgaagagaaatcttatgaacatggtgaaaatgctaaagctttcagttataagaaagatcagcattggaaatttcaaactttggaggaatcttttgaatgtgatggatctggacaaggtttatatgataagacaatttgtattacacctcagagttttctaacaggagaaaagtcctgtaaggatgatgaatttagaaaaaactttgataaaatcactttatttaaccacatgagaactgacacaagggggaaatgctctgatcttaatgaatatgggacatcctgtgacaaaaccaccgctgttgaatacaataaagttcacatggctatgacacactatgagtgtaatgaaagggggattaatttcagtaggaagtcacccctcactcaatctcagagaactattacaggatggagtgcttttgaaagcaataaatgtgaagaaaattttagccagagctcagcccatatagtacatcagaaaacacaagctggagataaatttggtgaacataatgaatgtacagatgccctctaccagaaattagactttacagcacatcagagaattcacacagaagataaattctacctttctgatgaacatgggaaatgcagaaaatccttttaccggaaagcacacctcattcagcatcagaggccccactcaggagagaaaacttaccaatatgaggaatgtgcaaaatccttttgttcaagttcacatcctattcagcatcctggaacttatgtgggattcaaactttatgaatgtaatgaatgtgggaaagctttctgtcagaattcaaacctcagtaaacatctgagaattcacaaaaaaaaaaaaaaaag

SEQ ID NO: 22 - DNA, 2084 bp, Homo sapiens
actcgcccttccggctcggcctttagttagtgaccagctcctcggcgttctgcagagcgtgggtttcagcgagttctacgtgccaggtccgcccggtgccggcttcctcgctgcccctggcggctcgtcagcccccactacccctgaacttggtcccaatggcggcccgcccctccttcacccggaccgtgggcatctgggcctcgccgaagccgtcaaggtggctgctcgggcttctagagcccgtgtccagccctttgccaccgaggcctgatcctcttttctgccctaaagaacttgccctgacagcctctggctcccgctcttgaggatcttgcttgtccaaacccagaagacagtgcatgaagccaggggacatccgccatgctccaaacaacttggcctcaggagtcagtgacctttgaggatgtggctgtttacttcacccagaatcaatgggccagcctcgaccctgcgcagagggccctgtacggggaggtgatgctggagaattatgcaaatgtggcttctctggtagcgtttccattccccaaacctgctctgatctcccacctggagagaggggaagcaccatggggcccagatccctgggacaccgagattctgagaggcatcagtcaaggtggtgagtcctggatcaaaaatgaagggctagttataaagcaggaagcctctgaagaaacagagttgcacagaatgccagtaggaggacttctcaggaacgtttctcagcactttgattttaaaaggaaggcactgaagcagactttcaatctaaatccaaatctgatacttcgaggtggatcagttgaggtcaggagtttgagaccagcctgaccaacatggagaaaccctatctctactaaaaatacaaaaattagctggatgtggtggtgtgtgcctgtaatcccagctacttgggaggctgaggcaggagaattgcttgaatccagaggcagaggttgcagtgagctgaggttgcaccactgtgcttcagcctgggtaacagagtgagactgtctcaaaaaaaaaaaaaatttagttccaaatattactgctcgttgataatgtgtctggtcacccaagagttctgatggagatgtacaaagagattaatgtttttatgtctgctaaacaacatccattctgcaggatccattactccatgggtcaaggagtaattttgactttcaagtattatttaaggaatacattttgtaaggctgtggctgccatagtggttgttctgtacaaagtaacttgaaaaccttctggaaaggattcatcattctagatgccattaaggacatttgtgattcatgggagaaggtcaaaatatcaacattaacaggagttcagaagacattgacctcagccctgatggatgatcttgaggggttcaagacttcagtggacgaagtaactgcagatgtggtggaaatagcaagataactagacttagaagtggaacctgcatatgtgactgaattgctgcaatctcatgataaaacgtgaacaaatgaggagttgcttctaatataagagccacaaaagtggtttcttgagatggaaactactcctggtgaagatcctgtgaccattgttgaaatgacaacaaaggacttagaatattacataaacttagttgataaaacagcagcagagtttgagaggattgacttcaattttgaagaatgttccactgtgggtaaaaggctatccaacagcaacacatgctacagataaatctttcggaaaggaagagtcagttgatgttgcagccttccttgttgtctcatttaaagaaatctctagagccacactaaccttcagcaaccaccacaccgatcattcagcagccatcaacagtgaggcaagactgtcttccagcaacaaagactcactgaagacttagattatcgttagcatcttttagcaataaaatatttttaaattaaagtatgtacattgtcagatataatgccattgcaaacttaatagactataatatagattaaacataacttttataggtcctggaaaaaaaaaaaaaaaaaaaaaaa

SEQ ID NO: 23 - DNA, 1987 bp, Homo sapiens
acaagatggccgctgcgcgcccagaggcccagagtcggagctcaccgactccggagtcgcgatcccaggagccactggacctggtcctggtgcctgatgactgccggcctggcacacccccgagtgacctcatcgagatccaggtggtgaaggtgacggacaccacgctggtccctgagcccccggagccaggttctttccactgtgccttgtgccctgctgccttccggctggtttccgagctgctgttccacgaacatggccacttggctggggccgagggaggcgggcagggtggggacccgagccggtgccacgtgtgcggccacagctgcccgggccccgccagcctgcgcgcgcactacagcttgcacacgggggagcggccctaccgctgcgcgctctgcccccgcgccttcaaggccttggcgcccctgctccggcaccagcaccggcacggggtggagccgggcacctctcggaggcctccggacacagcggccgttgcagaacagaggcccggggtggccccggagagggcggaggtggtgatggcggcggcggcggcgggcgcagcggtggggaagccttttgcctgcaggttctgcgccaagcccttccgccgctcctcagacatgcgagaccacgagcgcgtgcacactggcgagcggccataccattgcggcatctgcggcaagggcttcacccagtcctcggtgcttagcggccacgcccgcatccacactggcgagcgcccgttccgctgcacgctctgcgaccgcaccttcaacaactcctccaacttccgcaagcaccagcgcacccacttccacgggccggggccggggctgggagactctggaggccagctgggctcgtcggcggctgaggggtcggggagcgggtgtggggtaggggaccctgcggaggaggggcggggggagaccgcgaaggtgaaggtggaggccgaccagtaggctgcagaccagggacatgggttagttaaggcggaggtacgaggccgacccggggagggggacggggtggggaaacggaggcaggggacagaagaggggagattgggggagagatgacagctgcagggatggttgtgagccgctagtgatggagagcagagggagagggccaggctccagactcccacacgcccacacagcacctctgccaggcctaggagaggacaggtgcagctcttgcagctctgcgggtgtgcggccaaaggcaaggcccacgggctggatgtcacttccccgactgtctcttggttggcttgtccttgtgcaagacccagcctgtcacgacagagcctgggcacttcagaggaggagccaggatcgaatggaaggggggaattggggtccaccatagtcttctgctctggtcctccacgggtggaccaggatggtgtctcttgcctacctcactgcattgcactggacctgggatgcctatccaccctctggcagaagacactcaccaggttatctgtgaagagactctgggatcccatcacctcaaagccagagggtccccaagtcaccgctgagagcacttgagcctcaaggatgtaagcctgaccataggaccttgactccaacagcggcaacccccacccccattgtggtccgtccttaacccatccactcttcttcggaggcaactgagaacacataaagcaagcagctacctagcatccccctcctaaagctttagactcagagcccagggtcccccacaagcctcaaggtagcctcaggtttctctaatttcctccactcccagttcgaagcaaacagcttactgcctagtccccgccaatcccaagggcgggctggctgatggcagcatggtgggctggcctgggtgtggagtgaaagagtcactgtggtgggggcgagaggaggacttgggagctggaggtgtgacaccttcagttctgttcctattaaaggaccttctgaagggc

SEQ ID NO: 24 - DNA, 2434 bp, Homo sapiens
gcaggcgcagtggtccccgcaggcttgcgcgcgcactcgctgcgggacaagcttctggaagctctttgcggtggcgttggtgctgtttgcggatgctgatgcagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaagatccagtctctcaagattctactgtttcccaagaggagaactcaaaagaggataaaatggtcactgtttgtcccaatactgagtcctgtgaatctataacattgaaggatgtagctgtgaacttttcaagaggagagtggaagaagctggagccttttcaaaaggagctatataaggaagtgctactggaaaacctcaggaacctagaatttctggactttccagtttcaaaattagagttgatttcccagctaaagtgggttgaattgccatggctgctggaagaagtctcaaaaagctcccgactagacatacatggagcagtaaaaaagatgcagatgttctctgaggctgaataagaccatgctctgccttcttgtttcaactgttacacagagatgaccagaggatggggccactgcagtgcagttcaagaggctctggttcggggaagagctggatggagtatgaatcccaactctgggggtattagctagtggagtggccataggcaagttacttaacacttctgaacctccttttgtctttcataaaataaaagctactaggatgagttgttttaaggatttcagattatagtctatgtgagatatgtgcaaacatgtacatatttcccctagaagcaatggttttcagccttggtggtgaccttatagaacataaatattgtgaataatgaaaatccactgaatctaataagggacttgtatcggtaagatgtaaagaactcttggccaggtgtggtggctcatgcctataatcccagcactttgggaggccaaggcaggtggatcacctgaggtcaggagttcgagaccaacctggccaacatgacgaaactccgtctctatttaaaatacaaaaattagctgggcatggtggtgcatgcctgtaatcccagctactcgggaggctgaggcaggagaatcacttgaactcgggaggtggaggttgcagtgagccaagatcgcgccactgcactccagcctggatgacagagcaaaaaactgtctcaaaaaaaaaaaaaatcttacaacctcacaaataacctagttcaaaaatgggcaaagattttgaacagatatttctccaaagaagatatacaaatggcaaatacatacgttgaaagatccttaatattgttagccatagggaaatgcaagtcaaactcaaatcagaatgaaatatcacttcaaacctactaggatggttataataaaaaagacagacaatagcacgtgttggtgagtatgtagagaagttggaaccctcatacactgcttgtgggaatgtaaagtactgtagccactttgcaaaacagtttgacagctcctcaaaatgttaaacatgaaattatcatatgacccagcaattctactcataggtatatacttaaaagaaatgaaaaatccacacaaaaacctctgcatgaatgttcatagtaacattatacttcatagccagaaagtataagctaatacccatcaggctgggtgtggtggctcacgcctgtaatcctagcactttgggaggccgagttgggaggtttgcttgagcccaggagttccagaccagcctgggcaacatggcgaaaccccatctctactaaaaatataaaaattagttgcgtgtggtggcacatccctatagtcccagctacttgggaggctgaggtggaaggactgcttgagcgagggaggtcgaggctgcagtgagccacgatcacaccactgcactccagcctaggtgacagagtgagatcctgtctc

SEQ ID NO: 25 - DNA, 2675 bp, Homo sapiens
cgttcttacttctcctaaaggcccaggctgtgtggccccgtgtcctgcaggtattgggagatccatagctaagacaccgggacctcctggaagccaaaaatgtaatgtgttctcattttgcccaagacctttggccagagcagagcatgaaagattctttccaaaaagtggtactgagaagatatgaaaaatgtgaacatgacaatttacagttaaaaaaaggatgtataagtgtggatgagtgtaaggtgcacaaagaaggttataatgaacttaaccaatgtttgacaactaccccaagaaaaatatgtcaatgtgataaatatgtgaaagtccttcatcaatttccaaattcaaacggacaaaagagaggacatactgggaaaaaacctttcaaatatatagaatgcggcaaagcttttaagcagttctcaactcttactacacataagaaaattcatactggagggaaaccctacaaatgtgaagaatgtggcaaagcctttaaccactcttgtagccttactagacataagaaaattcatactggagagaaaccctacaaatgtgaagaatgtggcaaagcctttaagcactcctccactcttactacacataagagaaatcatactggagagaaaccctacaagtgtgataaatgtggcaaagcctttatgtcatcctcaacccttagtaaacatgagataattcatacggaaaagaaaccctacaaatgtgaagaatgtggcaaagccttcaaccggtcctcaacccttactacacataagataattcatactggagaaaaaccctacaaatgtgaagaatgtgacaaagcctttaagtactcctatacccttactacacataaaagaattcatactgaagacaaaccctacaaatgtgaagaatgtggcaaagcctttaagtactcctctacccttactacacataagagaattcatactggagagaaaccctacaaatgtgaagaatgtggcaaagccttcaagcggtcttcagaccttactacgcataagataattcatactggagagaaaccctacaaatgtgaagaatgtggcaaagcttttaagtactcctctaaccttactacacacaagaaaattcatactggagagagaccctacaaatgtgaagaatgtggcaaagccttcaaccagtcctcaatccttactacacataagagaattcatactggagagaaattctacaaatgtgaagaatgtggcaaagccttcaagcggtcctcacaccttactacacataagataattcatactggagagaaattctacaaatgtgaagaatgtgacaaagcttttaagcatttctctaaccttactacacataagaaaattcatactggaaaaaaaccctacagatgtgaagaatgtggcaaagcctttaagcactcctctaaacttactacacataagagatttcatactggagagaaaccctacagatgtgaataatgtggtaaagcttttcacctatcctcacaccttactgcacataagataattcatactggagagaaaccgtgtgaatgtgatgaatggggaaaatcttttaaccagccctcaatttctaactatgagaattgatatgaaatataaaccctacaaatgtaaagaatgtgacagattttttaaggaacttctcaacctttattacacataattcatactggaaagaaaccctacaagtgtgaagaatgtggcaaagcatataacaagttctgtctttttttttttttttttgagatggagtttcaactcttgtcacccaggctggtgtgcaatagcacaatctcggctcactgcaacctctgccttctgggttcaatccattctcctgcctcaacctcccaagtaagggggattacaggtgcccacccccatgcccagctaacttttgtatttttagtagagacaaggttacaccatgtttgtcaggttggtatccaacccctgacctcacatgatccacccacctcagcctcctaaagtgttgcaattacaggcatgagccaccatgcctggccacaagttcttactattaagagacatggtgataattcattctgaagaggaactctacaaacctgaaagatgtgacagtgcttttttcaacacttccatcctttctatacataaaaaatttatactagtgtgaaaccctagaaatatataaaatgtgaaacagcctttatatggttgccacatttgatagtaagataattcatactggcaaaattcctacaagcatgaagaatgtggcaaaacctttaatcaatgtgtacatcttattttgcaggaaagctattatccctgagaaaaattgtacaaatataaagaatatggaaaacccattaatgcctactcacatcttactcaacataagaaggttcatagttaatgaaagcattaaaagtgcaattactgtcaaaaaatctttcagaaaatataagcctttaaagtgaagaagagtatttattctgaagacaaccattacaaatatacaggaggtttattacacacattttgtactagaggaaaatcctgaagcagttgctcaagctttgctcaacatcagagaacttatattggagaagagtcctgcaaatgtaatgaatttggaaacacttt

SEQ ID NO: 26 - DNA, 2820 bp, Homo sapiens
gcttttacgcagtgttttgaggtgcaggactgcaatgcgcgcacttccggaccccagactcttcctacggcgactgacacctcagacacgcgttgtggggggcggcgctctggctccggggctgtgcccagcgcgagcgtggccggcacccacttgctgcagagccggcactgcactggggtccttgggggcgactcctccagacgtctctgcgggttgtcgggtgctgccgagttgggttgggggacgctacaggtagtgggtccggagcagcggctggcccctcatctcactgcccttcctcggaccccaccgtcctctggaagcttgtgcagggcacctgccactgtgaccacctggacgcagatacctgctttcccacaacagcaaggaagaaccatggcccaggggtcactgtcattcggggacgtggctgtgggcttcacccggaaagagtggcagcagctggacctggagcagaggaccctgtaccaggatgtgatgctggagaactacagccacctgctctctgtgggctgaactgtctgcttgcttggaaggcccagctggctcagcacaaatcctttaaccgtttctccccaagagggtgtcaagtcagcaaaccagctgtgatctccagtttggagcaggggaaggagccatggatggaggaggaagagataaggacgtggagcttcccagaagaagtttggcaagttgctacccagccagatagccaacagcaacacgaagaccaacatttgagccatacgtttctagacaagaaagactggaccggaaatgagcttcatgaatgtaacgaacttggaaaaaaactccatcagaacccaaacctccttccatcaaaacagcaggtccgcacacgtgacttgtgcagaaagagtttgatgtgtaacctggacttcactcctaacgcctacctggcgaggaggagatttcagtgcgacggccacggaaacttcttctctgttcgaaacttgaaactccaccttcaggagcgaatccacgcggaggtcaccagtgtggaagtgctttaagctgtgacgagggagttcctgcagctcagggagccagtagtgagaaaccccacgaatgcacgaagtgtgggaaagccttgtgctgcagatcggacctcagggtacatcacggggtccacgcgggggagaagtcctctgcgtgcagtgaacgggggagtggtttcagggagaagctttgccctgacaaacagggaacttacacaaaggagaaacccgctagagacagcagaagtggtaaaacgatcttccggaagacacgcctgtgtgtcccgggcacagttcacgccggagcgaagccttacaagtgttgggagtgtgagaaaacctcccacaagtcgcgcctcatcgagcaccttcgctcccacacgggggagaagccctgcggctgcagggaatgcggaaaggcctttttccagaagtcacacctcatcctgcgtcagaggactcacacgggggagaagccctgcgactgcgcggagcgcgtgagccactttagccaggatatacttaattataaagacaactgtggatatgaagtttttttttcttttgagatgaagttttactcttgttgcccaggctatgggaagaaatgaaatcattacgactaacagatctaaaaagcgtgagaacatcccagagggacgcaggggtgtgttccaagtgtgctacagacagataatttttatttttgtgttgcactggtgaacagaacataattgtgaatctgtagacatacataccataatatatagaagatctatggatactttctatgctaaattatacccttctgtgtttgtgatatagaactggaataagatgaatatattattaaagcagagaggcccactgcagcagcacataccatttcttctgtttgtcatcacgtattacagagcccctgaacttggaagctaacaatttcatgacatctgataactcacagtcaactagtttataagttatatttttggctgggctcggtcgctcacacctgtaaacccaacactttgggaggctgaggcgggcagatcacatgaggtcaggagttcgagaccagcctggccaacacggtgaaaccccgtcactgaaaaatataaaaattggctgagcatgctggtgattttctgtaatcccagtaatcccagctacttgggaggctcaggcacgagaattgcttgagcccggcaggcagaggttgcagtgagctgagattgtgccacttcattccagcctgggcgacagagcaagactctgtctcaaaacaagctatatttctatattaggactccattttctggcaatacggtggaccgtctaaagtgaaaatcaccggggcagtggctcgtgcctgtgatctcagcacttgggaaagtcaaggtggacaggtcacttgaccccaggagttcaagaccagcctgggcaacacgaaagctgacttcatgagaccgaggatctcgttcgttgatcgatgctacatattcagcatgttagataatgaggttggtgagattgatgaaatcccgcccaccagggccgacccacaaagagccactttatgaagaacatgctcctgaactccactccacaaccagcttttgaaaagaaaaatctgaaaaaatttgacctcagttaaactggtccaaatgcctgagcataaccaaaatctttcctcattcactcttcacgtggaccgtgtttaatttggttgctggtgatcatatttgttttagtaaaggctgtcactctatcttgggcg

SEQ ID NO: 27 - DNA, 2524 bp, Homo sapiens
gtcaatatggctgcgttgggatctgttcaccttcaggctgagtcgagactgaggtgaaaaagcggaaaaacgcgagaaaaggtttccccgttgtacagaggctagagtgaggctcggctgaatcggttgcaggcgttggtgcctctgtcagcgtccaggtcactgccgctcccgccccgctcttccctggctgtgctggcggaggctgcgccgatgaacctgactgaggattatatggtttttgaggacgtggccatacatttctcccaggaggagtggggaattcttaatgacgttcagagacacctgcacagcgatgtgatgctggagaactttgcacttttgtcctcagtaggttgttggcatggagccaaggatgaggaggcaccttccaagcaatgtgtttctgtaggagtgtcacaggtcacaactttaaagccagctttgtccacccagaaggcccagccctgtgagacatgtagctcacttctgaaggacactctacacctggctgagcatgacggaacacaccccaagcgtacagccaagctttacctgcaccaaaaggagcatcttagagagaagctcaccagaagtgatgaagggaggccttcgtttgtgaatgacagtgttcacctggcaaagaggaacctcacatgcatgcagggtggcaaggattttactggtgattcagatcttcaacaacaggctcttcacagtgggtggaagccacacagggacactcatggtgtggaggcctttcaaagtggacagaataattacagctgcacccaatgtgggaaagacttttgccaccaacatacactgtttgagcaccagaaaatccacacagaggaaaggccttatgagtgcagtgaatgtggcaaattgtttaggtacaactccgaccttattaaacatcagcgaaatcatactggagaaaggccttataagtgtagtgaatgtggaaaagccttcagcctcaaatacaatgttgttcaacaccagaaaattcacactggagaaaggccttatgagtgcagtgaatgtgggaaagcttttcttagaaagtctcacctacttcagcaccagaggattcacaccaggccaaggccttatgtgtgtagtgaatgtgggaaggccttccttacacaggctcaccttgttggtcaccagaaaattcatactggagaacggccttatggatgcaatgaatgtgggaaatactttatgtacagttcagcactcattagacatcagaaagttcacactggagaaaggcctttttattgctgtgaatgtgggaaattctttatggacagctgcacactcattattcaccagagagttcatactggagaaaaaccttatgaatgcaacgaatgtgggaaattctttagataccgttccacactcattagacatcagaaagttcacactggagaaaagccttatgagtgtagtgaatgtgggaagttctttatggacacttccacactcattattcatcagagagttcatactggagaaaagccttatgaatgcaacaaatgtgggaaattctttaggtattgcttcacactgaatagacattagagagttcactctggagagaggccttatgaatgcagtgaatgtggcaaattctttgtggacagctgtacactgaagagtcatcagagagttcacactggagaaagaccttttgaatgcagcatttgtgggaaatcctttagatgtcgctccacacttgatacacatcagagaattcacactggtgaaaggccttatgagtgtagtgaatgtgggaaattctttaggcacaactcaaatcatattagacatcggagaaatcactttggagaaaggtcttttgagtgcactgagtgtgggagagtttttagccaaaattcccacctcattcggcaccaaaaagttcacactagggaaagaacttacaaatgcagcaaatgtgggaaattttttatggacagctccacactcattagtcatgagagagttcatactggagaaaagccttatgagtgcagtgaatgtgggaaagtctttagatacaactccagcctcattaaacatcggagaattcacactggagagagaccttatcagtgcagtgaatgtggaagagtctttaaccaaaattctcatctcattcagcaccagaaagttcacaccagataaagaatgtatatataaagcagatggggaaagacttcacacagaaatctactctgatttagcactgggacctacgttttaaaaaaagtattcttgtagaatacagataacataaaatctaacatcttaaccatgttaaagtgtatagttcagtaccgttaagtcattcacattgtgcaatgaatatctagaagtcttttcaacttatgaaactaagtctataccttttaaaaccttattcctcactccatccagcctcttgacaagcaccgctctgtatgaattttactagtccgggtacctcatataagaaaacttaagtttt

SEQ ID NO: 28 - DNA, 3588 bp, Homo sapiens
agtgcttgttggggccaggctttgtaacggtctcctgagcagcgagcagaaaatctgttatcgagagagagtgagcacagtgacctgcccctaaaggttcatgcgcatccctcagacccctctttagacgcgccccgcttctccctctgccctctccccttgcccaagccccgaggtgggggcctggtgtgaatgctccggccgaagtgaacctgcacccccgcacccgaaggcctctttccggcttctgggcaaggcggccccggtgagcacggccgtcacacatctctgctttttcccaagaagagcaggaaatggccaaaccccagtcctgcaagctgtacaagaagcatgacaccagcatctgcatctggtgaggactcaggaagcttctactcatggcagaaggcaaagagggaacaggggctagtgacatttgaagatgtagctgtggatttcacccaggaggagtggcagtacctgaacccaccacagaggaccctgtacagagacgtgatgctggagacctacagcaacttggtctttgtggggcagcaggttaccaaaccaaacctcatcctcaagttggaggtagaagaatgcccggcagaaggaaaaatcccattttggaactttccagaagtctgtcaagttgatgaacagattgagaggcaacatcaggatgaccaagataaatgtctgctgatgcaagttggattttctgacaagaaaacaattatcaccaagagtgctcgtgactgtcatgagtttggaaacatacttcatctgagtacaaaccttgttgcttcaatacaaagacccgataaacacgaatcatttggaaataatatggtagataatttagacttatttagtagaagttctgcagaaaataaatatgataatggatgtgcaaaattgttcttccatactgagtatgagaaaacaaatcctggaatgaagccctatggctataaagagtgtgggaaaggtcttaggcgaaagaaaggccttagtctacatcagagaattaaaaatggagagaaaccctttgaatgtactgcatgtaggaaaaccttcagcaagaagtcacacctcattgtacattggagaactcatacgggagagaaaccttttggatgtaccgaatgtggaaaagcttttagccaaaaatctcagctcattatacacttgcgaactcatacaggagagagaccctttgagtgtcctgaatgtggaaaagccttcagagaaaagtcaactgtcatcatacattacaggactcacacaggagaaaaaccttatgaatgtaatgaatgtggaaaagccttcactcagaagtccaacctcattgtccatcagaaaacccacactggagagaaaacctatgaatgcactaaatgtggagaatctttcatacagaagcttgatctaattatacatcatagtacccatacaggaaagaaaccccatgaatgtaatgagtgtaagaaaactttcagtgataagtcaactctcattatacaccagagaactcatacgggagagaaacctcataaatgtactgaatgtgggaagtctttcaatgagaagtcaaccctcattgtgcatcaaagaactcatacaggagagaaaccctatgaatgtgatgtgtgtggaaaaaccttcacgcaaaagtcaaaccttggtgtacatcagagaactcattcaggagagaaaccctttgaatgtaatgaatgtgagaaagccttctctcagaagtcctacctcatgctgcatcagagaggtcatacaggagagaaaccttacgagtgcaatgaatgtgaaaaagcattttcacagaaatcatatctcattatacatcaaagaactcatacagaagaaaaaccctataaatgtaatgaatgtggcaaagccttcagagaaaagtcaaagctcattatacatcagagaattcatacaggagagaaaccttatgaatgtcctgtgtgttggaaagcttttagccagaagtcacagctcataatacatcagagaacgcacacgggagagaaaccctatgcatgcactgagtgtggcaaagccttccgagaaaagtcaacattcactgtacatcaaagaactcatactggagagaaaccctataaatgtacagaatgtgggaaagcctttacccaaaaatcaaaccttattgtacatcagcgaacccatgcaggaaagaaagcccatggaagaggccacactcggaagtcaaagttcatggcacattagagagctaatcagcagtatctattatggacactgaaagaaagttgtgtcaattttactcacattttaaaagtatattttgacttgtggtttaaatatgggagtaaattcagcctttcttcttttcatctcagtcataacccaaaagctacgggagaaaaagcagaagtgtaatctctgtatctgacaaaattaggagacagctgcaaccctaatgagagggctgccacaggcagaggaaatgaagcactggtgcaggagatttcagagtgagagtgctcaaggctgcaggtgcaagacagcactggtaaggactcttagctgaggttcgggatataccccgaggcgcggaaccatagatataacagtggtaacagtgcgtgggcaggtgggaggtaggatgtttcctagaccatttggggtctgaggagaaacaggctggggcctcgagaaggagtcactcagacaagccatatttttagaaagtagtctactgatgggagcaacagttatggcatgctgggggaagagaagggacttttccttgtgaagagccctacagctgcccctatttactgacttgggagaagtaaagtcagaaagaacgaacagctgtggggggaaaaaattctcagttgtcaaaaaaaaaaaaactgatctgcttagaatgtggccctggtttcttttcccacatgaacctccagcaaatagcaagtccaggaaaaactcttctcattcaaagaggaattattcaaaagtaatcaaaaccacaaatgcatttggtttttgggccagcaattccacttctaggaatgtacatactcacacatgtacaaaatgatgaacatacagaagtattcattaatgcagcgtttgtgaaaacaaaagattggaagctgtttaaatgacaccatatcagggttctggttccctaaattgtggtatattcatacagcctactcctgggtagacaacaatgaataaataaggagaacttggaaaccatttatgtagtgatgtgggataaccttcagtttatgttattaggtaggaaaaataaggttgaggacagtgactgccatttgtatataaaaaggagaaaaatggtaagtacataattgtgaattcataagttatctctggaaagagacatgagaacctggtaaccctgattaccttgggaggggaaggggcagtggtggctggggggatggaattgagagggagacaactgtatcctttcatagcttttgaaaatgtgggtgtactatgtactatgtggatgtactaccttttcaaaaataaaacatttaaaaagct

SEQ ID NO: 29 - DNA, 3381 bp, Homo sapiens
gaaaaagcccgcggcgtcttctctgtcacccgcgctcggctccctgctcggtcgggctggaacctgtactggcagccggaggtgtaggtaggaaccggaatacctcggaagccgggaaatgacggagtttcattcttgttgcccaggctggagtgcaatggcgcgatctcagctcaccacaacctctgcctcccacattcaagcgattctcctgcctcagcctcccgagtagctgggattacagtgtggtgtgttgaatattatagtttcaaaatccttcatgtgtgttaggactcaatgatctttgaggatgtggctgtgaactttacccaggaggagtgggctttgctggatccgtcccagaagaaactctacagagatgtgatgtgggaaatcatcaggaacctgatgtctgtaggaataaaatgggaagaccggaacattgaagatcagtacaaaaattccaggagaaatccaagaaatcatatggcagagagactctgtgaatgtaaagatggtcaatgtggagaaactttcagcctgattccagatggtataatgaacaagaacactcttcctggggtaaaaccatgtgaaagcagtgtgtgtggagaaggcaacgtggatcattcatctctgaattgctacatcagagctgacactggacacaaaccgtatgagtgtcaggaacatggagagaagccacataaatgtaagcagtgtgtaaaaaccttcagctgcctccactccttccaaacacatgaaaagcctcacacaggagagaaaccctatgattgtaaggaatgggaaaaaaccttcgattctccccaaaccgttcgaagatacagggtagtgcacagtggagatggaccttataaatgttgaagaatttgtgaccgtggataagttcgtttcctgttatgtgaacttggcagattaatgctaaatcctgtgggacagcatttagcaacacctaaaaaacatgataaagaaatacctgagactgggtaatttataaagaaaagaggttgaattggcccatgattctgcagactgcacaggaagcatggtactggaaggatggcatctgctcagcttctagggaggcctcaggaaactgacaatcatggtggaaggcaaagggggagcagcagttcacacggccagagaaggagcaagagagagcagggcaaggtgccacagacttttaaatgaccggttctcacaagaacttaccatctcaagaacagcaccacagggatagtgctaaaccattcatgaaggaccaccatccagtcacctcccacaaggccccaccttcaatattgggaattacaattcgacatgagatttgggtggagattcaaatccaaaccatgtccttttgcttttttctgttttgtttgtggagtagatttttctccatccctttactttgagcctaagggtgccattgcatgtgagatgggtctcttgaagacagcataccattggatcttgcttttttatccaagtcaccactgtgccttttaattggggcatttagcctgcttacattcaaggactcagtgacctttgaggatgtggctgtgaacttcacccaggaggagtgggctttgctgggtccttcccagaagaatctctacagagatgtgatgtgggaaaccttcaggaacctgatgtctgtagaagtcatatggtagagagagtctgaaggtaaggaagatggtcaatgtgaagagatcttcagccttgttccaaatggtatagtgaagacgacttttactggagtcaaatcatgtgaaagcagtgtgtgtgaagaaggcaatatggatcattcatctcttaattgctgcatcagagctgacactggacacaaatcagatgagtgtcagcaacatagaagccacatacgcagtgtgtgaaaaccttcagctattgccactcctttcaaacacatgaaaggcctcacactggaaagaaactccatgtaagaaatgtggaaaaaccttcatttctgttcaaaccttttgaagatacatggtaatgcacagtgaagatgaaccttataaatgtaagttttgtgggaaggcctttgataatctacatttatatcttacacatgaaagaactcacactggagagaaaccctatgaatgtaataaatgtgggaaagccttcagttgttccagttccattcgaaaacatgcaagaattcacactggagagaaaccctatatatgtaaacaatgtggcaaagcctttagatattccagttctattcgaaatcatgaaaacactcacactggtgaaaaaccctgtgaatgtaagcaatgtgggaaagcctttagttattccagttactttcgaatacatgaaagaattcacactggagagcaggtgtataaatgtaaggaatgtgggaaaacattcacttatcccagtgcctttcataaacataaaagtacccacacttcacagaaactttatgaatgtaaggaatgtgggaaagcatttgattgttttagttcctttcatagtcatgaaggggttcacactggagagaaaccctatgaatgcagaacgtggaaaagccttcagtagttctaagtacttaaaaatacatggaagaactcacactggagagaagtcctatgcagtaaagaatgagggaaagtattttattgtctcagtccccttcaaagacatgaaaggactcacatcagagaaaagttgtatgaatgtaaaaaatgtgataaagccttccattcgtccagtactgttagaaaccatgaaagaagtcacatttaagaaaaacacagtgatgttaggaatatggggaacctttcctttctcttccagtctttggaaggcacagggtatgacacactggtgaccttataactgtaaggagtgtggataagtatttattagtccttgtgtgttttagatacatgaaagaatttactcaaaaggaaactctatgaatgtaaagaatgtggtaaaacctgtgtagtttcagtttctcttgaataaagtcatttcctggtattctcaggggattggttccagcaccccttgagaatatataattttgctcaagtgctttacagaaaagtgtatttgcctataactaggcaatcctgtatactttaaatcatctctagattacttataatacctaatgcattgtaaatgctatgaagacaactgttttattgtatttagggaagtatgacaagaaaaaacatctgtacatattcagtacagacacaaccaccatacggctacctacctagtacacatcatctacaatataacattttctttttaaaaaacagttatggattggtttcattaaatgacctgcaagcgtgtgtt

SEQ ID NO: 30 - DNA, 2479 bp, Homo sapiens
agatcccgcctccacggcgatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatttttttggggatggcttctttgagtccaacaggccattgatcttttcaagatgcattccagatgaactgctaggtgagggggaagcttcatttttgttacctgatagaatagcttttcttatgagatatatataatgtgatactatgtttggatatttttggtcttaaagcaagactcagtggtgtatcttcattaaaagcttcctttaaaaaagttacagagttactaaaaaaacaagtacccaaacaatcaagttgggccaaccttggaaccttgttttgaatatctttcattgttttgtttgtcgtattgtaaaaagaatgtatggttgaaaactcaggaatgtttataaaacaaattatttcacaaaaaaaaaaaaaaa

SEQ ID NO: 31 - DNA, 2207 bp, Homo sapiens
actgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttgaaaaaaaaaaaaaaaaaaaaaaaaaaaaa

SEQ ID NO: 32 - DNA, 2892 bp, Homo sapiens
gcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagctgcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagtgttctctcgacactgccagccccgtgttagcacctgggcctcagtcccacttgctcccaggcgccggttctgtggttggtttggaattaaagtcctgtttgaagttgtcagacacagacatgaatttctgggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtgggcggcctgggcagaagggcggctggctgtcctggagctgctgctggagcctgccctcagagtgtccctttccagtgctgtggcattctgtggcagcttccccaggtgtggtgacggggggggggcggggcctccacctgtgacagccaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccagagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaaaaaaaa

SEQ ID NO: 33 - DNA, 4314 bp, Homo sapiens
cgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaac

SEQ ID NO: 34 - DNA, 2985 bp, Homo sapiens
tcgggcacggcgtcctccctccgcagcagccgagccggacctgcctccccgggcgtgctccgccggccccgccgccggcccgcagcgacagacaggcgctccccgcagctccgcacgggacccaggccgccggaccccagcgccggaccaccctctgtccgccccgaggagtttgccgcctgccggagcacctgcgcacagatggagctggaccaccggaccagcggcgggctccacgcctaccccgggccgcggggcgggcaggtggccaagcccaacgtgatcctgcagatcgggaagtgccgggccgagatgctggagcacgtgcggcggacgcaccggcacctgctggccgaggtgtccaagcaggtggagcgcgagctgaaggggctgcaccggtcggtcgggaagctggagagcaacctggacggctacgtgcccacgagcgactcgcagcgctggaagaagtccatcaaggcctgcctgtgccgctgccaggagaccatcgccaacctggagcgctgggtcaagcgcgagatgcacgtgtggcgcgaggtgttctaccgcctggagcgctgggccgaccgcctggagtccacgggcggcaagtacccggtgggcagcgagtcagcccgccacaccgtttccgtgggcgtggggggtcccgagagctactgccacgaggcagacggctacgactacaccgtcagcccctacgccatcaccccgcccccagccgctggcgagctgcccgggcaggagcccgccgaggcccagcagtaccagccgtgggtccccggcgaggacgggcagcccagccccggcgtggacacgcagatcttcgaggaccctcgagagttcctgagccacctagaggagtacttgcggcaggtgggcggctctgaggagtactggctgtcccagatccagaatcacatgaacgggccggccaagaagtggtgggagttcaagcagggctccgtgaagaactgggtggagttcaagaaggagttcctgcagtacagcgagggcacgctgtcccgagaggccatccagcgcgagctggacctgccgcagaagcagggcgagccgctggaccagttcctgtggcgcaagcgggacctgtaccagacgctctacgtggacgcggacgaggaggagatcatccagtacgtggtgggcaccctgcagcccaagctcaagcgtttcctgcgccaccccctgcccaagaccctggagcagctcatccagaggggcatggaggtgcaggatgacctggagcaggcggccgagccggccggcccccacctcccggtggaggatgaggcggagaccctcacgcccgcccccaacagcgagtccgtggccagtgaccggacccagcccgagtagagggcatcccggagcccccagcctgcccactacatccagcctgtggctttgcccaccaggacttttgagctggggctgactcctgcaggggaagccctggtccagctgggtgccccctcgagctccgggcggactcgcacacactcgtgtcatccagatgtgagcaccgcacccagcggcaaagagccctcccccctgcagggctccacccatcaccctccctccgtctgtctttccggcctggaccccaccctccacactctcaggccatcacagaacaccccagcttcctcattctgctacaacacccaggccctctggacatccagaaaaccaagtgtccggatggcaggggccagcggccaccaagctcatgggacacccagagcagaagctagggcagagccaatgctgagggagcctcgacttccggcgccgccgccctctcccggcatccgcagagccagctgacgccctccctgcctcccagggcagctggccagcctcgggcagcgcggccccctcctcccaggggagagtagaagtcgcacacgcagcagagcagacctgatgtcccggtgcttcctggcccctcagctccagtgattcacgcccgcctggagaagaatcagagctcagctcatgactcacccatggcaggcggagggtcccagaggggctgagtcctcaaatccggctgaggcagcagctggcaccatcagagccaggagagtgacaacaggtctcaaggttcccacaaagtctttgctgctgtgctgggcaccacccacccctcaccttgcaggctgcctgcgtgggaggcgaagtcccaggacagcccagaggggggctacagagaggagtcggctgcagcagagggcaggagccccagcttagccctgagcgccagcgcgaggaccagggcctgccactaagcccgccccgctggccgccagctgcccgtccccagagccactgcagcaggagtcgggccctgcctccctcccagcagggaaaccccgcccgctgccaggccatcctctctgccagaggctttcatgagccccaaggctggggccacagctcctacccctgcccagcagccctgagctcagctgcaggaaggacatcccagaagccatggctcctggggcgcttccaggcattctgccctgccccgacaccagaaccctggtgctggtgggccactagcgtctgcagcctaagcaggtgctggctcagggttcatcgttctgccttgtccactgggggaccagccctgcagaccactctgacaagtcttcagcccacaccctgccagccccacagattttatttttgcacataagccataaccaatcctcaaggctggcacaggctttggggaagccctggagcctgtgaagaccctggaaacctcatgaggctgtggccaacccctgccccttgccccacacagaccaggccttaaatgtcggtccaggccctgtgcaccttaccccagagacagactctttttgtaagattttgttaataaaacactgaaacttcaaaaaaaaaaaaaaaaaaaaaaaaaaaaaaaaaaaaaaaaaa

SEQ ID NO: 35 - DNA, 8585 bp, Homo sapiens
cagaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgccgcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcggggggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaagacttt

SEQ ID NO: 36 - DNA, 4081 bp, Homo sapiens
gtggggacgactcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattataaaaaaaaaaaaaaaaaaaaa

SEQ ID NO: 37 - DNA, 1716 bp, Homo sapiens
acttgcgttgcacccgggctgagtgcggccgcgacggggcgggcggactctcgggcgctcagagctggcctcgggtcctcggagcctggcgctcgaacctcccttccgacctccacccggaccccgaccccgacccggcctggcccggcccccgcccccgccccccgggccgatggactactcctacctcaattcgtacgactcgtgcgtggcggccatggaggcgtccgcctacggcgactttggcgcctgcagccagcccggcggcttccaatacagccccctgcggcccgctttccccgcggcagggccgccctgccccgcgctcggctcctccaactgcgcacttggcgccctacgcgaccaccagcccgcgccctactcggcagtgccctacaagttcttcccagagccatccggcctgcacgagaagcgcaagcagcggcgcatccgcaccacgttcaccagcgcgcagctcaaggagctggagcgcgttttcgctgagacccactaccccgacatttacacgcgtgaggagctggcgctcaagatcgacctcactgaggctcgcgtgcaggtctggttccagaaccgccgggccaagttccgcaaacaggagcgcgcggccagcgccaagggcgcggcgggcgcggcgggcgccaaaaagggcgaggcgcgctgctcctccgaggacgacgattccaaggagtccacgtgcagccccacgcccgatagcaccgcctcgctgccgccgccgcctgcgcccggcctggccagcccgcgcctgagccccagcccgctgcccgtcgcactgggctccgggccgggacctgggccggggccacagccgctcaagggcgcactgtgggccggtgtggcgggcggtgggggcggcgggcctggcgcgggagcggccgaactacttaaggcttggcagccggcggagtccggccccgggcccttctccggggttctgtcctcctttcaccggaagcccggccccgccctgaagaccaatctcttctagctgccggcctctggaggctccgagcctgcccccagagacgtccctgcccctccaggacctgacagcccctcccatcctggccacccgcctggaagtccccatccgtctccactccctactgtctcacccctcggtgtgtcctccccaactttggagaccaagtcagggccactctcgtcctcacccaccctctaccagcagagcggagttctttataccgggacctcctccaggagaaccccggagctccttctagcttggccttctttggatgcggtatcacatgaggcctgtccctaacagtgccctcaaagtgaaggtcctcaaggaggatcggcacagcccccttccctggctctgcagcggctgggtcaccccttacgctggtgatcaggaaagcccgctgccccacccctcgggcccacccgtacagaggctggtggtcgccgggataattaatgaccaccgccaattcatccctcacgtgtctcctctcttccctagcccgtctggcacagagggtggacctgttagaggagtggaggggctgcctggggaatgggacagagggattctctttccctaatttttttggttgtcctttttctttgaaaaacttgtaatttattgaagttttactcaatccaaataaaacttaatttattgaagacaaaaaaaaaaaaaaaaaa

SEQ ID NO: 38 - DNA, 4846 bp, Homo sapiens
atcttggattccgcggtagcggaggcggcggtcaggcgccgcttctggggagtggcctttcttttcccctccctcccggttcggtggcggcggctcctcccactgggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgaaaaaaaaaaaaaaaaaaaaaa

SEQ ID NO: 39 - DNA, 6576 bp, Homo sapiens
gcggccgcggcggcggggagagcggagggagcgccgcccgcccgcgccgtcctttgtgtggcggcggcggcgcctgggcctgaccgggtccccggggctgagcgccgggctccgcgccgcccctcccgcgcccctgccaagcgggcgcctatcctctccgagcaagatggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggttgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacatgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctgaacaacaaaaaaaaaaaaaaaaaaaa

SEQ ID NO: 40 - DNA, 2812 bp, Homo sapiens
ggaaagtaggttagtggtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggttccgatgtcataggaatctacgctagagggcttcctgtgtgccgggcactgtggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctataaaaaaaaaaaaaaaaaaa

SEQ ID NO: 41 - DNA, 1930 bp, Homo sapiens
gaccaagtggctcctgcgatggcggcggaagaggaggctgcggcgggaggtaaagtgttgagagaggagaaccagtgcattgctcctgtggtttccagccgcgtgagtccagggacaagaccaacagctatggggtctttcagctcacacatgacagagtttccacgaaaacgcaaaggaagtgattcagacccatcccagtcaggaatcatgacagaaaaagtggtggaaaagctttctcagaatccccttacctatcttctttcaacaaggatagaaatatcagcctccagtggcagcagagtggaagatggtgaacaccaagttaaaatgaaggccttcagagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaagggcaacagcgattttaggatatctgcctcaggaacttttgggaacttcttgttatgaatattttcatcaagatgaccacaataatttgactgacaagcacaaagcagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgggacatagtgagcctggagaagcatcatttttaccttgtagctctcaatcatcagaagaatcctctagacagtcctgtatgagtgtacctggaatgtctactggaacagtacttggtgctggtagtattggaacagatattgcaaatgaaattctggatttacagaggttacagtcttcttcataccttgatgattcgagtccaacaggtttaatgaaagatactcatactgtaaactgcaggagtatgtcaaataaggagttgtttccaccaagtccttctgaaatgggggagctagaggctaccaggcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctagc

SEQ ID NO: 42 - DNA, 2885 bp, Homo sapiens
ttgtcctgagcgcggagagggcgagctcgggccgcgggcagggcgggagccggcagccggcaaccaagggaggcagaaaggcacaaagatcgcaataatatccgttataacccgctatctaaccccacccccaacacacacccatccatcccaccctccgggagaggcagccggcgatccgctctctgcgccctgggaaaaagccccagccatgagcaatcagtaccaggaggagggctgctccgagaggcccgagtgcaaaagtaaatctccaactttgctctcctcctactgcatcgacagcatcctgggccggaggagcccgtgcaaaatgcggttgctgggagccgcgcagagcttgcctgctccgctgaccagccgcgccgacccggaaaaggccgtgcaaggctcccctaagagcagcagcgccccgttcgaggccgagctgcacctgccgcccaagctgcggcgcctgtacggcccgggcgggggccgcctccttcagggtgcggcagcggcggcggcggcggcggcggcggcggcggcagcggccgccacggccacggcgggtccacgcggggaggcccctccgccgccaccgccaaccgcgcggcccggggaacggccggacggcgcaggggccgccgcggcagccgcggccgcggccgccgcggcctgggacacgctcaagatcagccaggcgccgcaggtgagcatcagccgcagcaagtcgtaccgcgagaacggggcgcccttcgtgccgccgccgcccgcgctggacgagctgggcggcccggggggcgtcacgcacccggaggagcgcctcggcgtggccggcggcccgggcagcgccccggctgcgggtggtggcaccggcaccgaggacgacgaggaggagctgctggaggacgaagaagatgaggacgaggaagaggaactgctggaggacgacgaggaggagctgctggaggacgacgcccgcgcgctgctcaaggagccccggcgctgtcctgtggccgccactggcgccgtggccgcagcagctgccgctgcagtggccacagagggcggggagctgtcacccaaggaggagctgctgctgcacccggaagacgctgagggcaaggacggcgaggacagcgtgtgcctctctgcgggcagcgactcggaggaggggctgctgaaacgcaaacagaggcgctaccgcaccacgttcaccagctaccagctggaggaactggagcgggccttccagaagacgcactacccggacgtcttcaccagggaggaactggccatgaggctggacttgaccgaggcccgagtccaggtctggttccagaaccgtcgggccaagtggcgcaagcgggagaaggcaggcgcgcagacccacccccctgggctgcccttcccggggccgctctccgccacccacccgctcagcccctacctggacgccagccccttccctccgcaccacccggcgctcgactccgcttggactgccgctgccgccgccgccgccgccgccttcccgagcctacctccgcctccgggctcggccagcctgccgcccagcggggcgccgctgggcctgagcactttcctcggagcggcagtgttccgacacccagctttcatcagcccggcattcggcaggctcttttccacaatggcccccctgaccagcgcgtcgaccgcggccgcgctcctgagacagcccacacccgccgtggagggcgcagtggcatcgggcgccctggccgacccggccacggcggccgcagacagacgcgcctctagcatagccgcgctgaggctcaaggccaaggagcacgcggcgcagctcacgcagctcaacatcctgccgggcaccagcacgggcaaggaggtgtgctaaaggctgccctccacacccgcgccccgcgcgcgccccgaaaggtcacctcactcagcaccactcaagaccaaatggaaacagaggaccagcacactcccgagacggcactgagagagcgcagccgccttcacagcagtctggatgcgggcatggcagccctcggcgctccgggacgtggcacctcctcggctggctgtccacccgcccctgcccctgcccctgctactgccaacctcgctccaactccaacatccactctctcttgttcttactttcctgaaaatatcggggaggttttctcccccagacgcctgatattgaagtaaaaaatttaaaaagcccaacctcttcctcctgacaccccacttagcctttcttttctttctttctttctttcttttttttttttaaatagcattttggcgctcgaagttgatctccccagcgagggccccagcgtgaagccagggcccgggaagcaaatgcgagcctgtaagatagctaacagtgcacttaaaggaaaggggcgtcttgttcttgttctcttctttatcatacaccaaccaaggtttttatatcaaaccaaagggaaataatactctgctagaatatggactgttgaagtcaccaaactgtgattattgattctgtacataccattgttattaaaaaaaaaaaaaaaagaacagagctttgtatatttgaaatgttataacgcaattgcactcagcgtggtatggtaaaagtttgtcctcccgtagattcttactgtgttgtagatacggtagggttcctagacaaatatttatgtactcaagccctttatttaacttattaactgtagaggcttccgaaaccttcaagataaaggcaatggtacagtacttttgtgtaatgtgtaattgttaccacttttccttgctatctagtggagaagtgtcacgctcaaaataaaaaaattatatgtttaacaaaaaaaaaaaaa

SEQ ID NO: 43 - DNA, 2490 bp, Homo sapiens
agcactctctcacttctggccagggaacgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggatcgctctgattccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcagggtgatcgcacaacctgcatctttagtgctttcttgtcagtggcgttgggagggggagaaaaggaaaagaaaaaaaaaagaagaagaagaagaaaagagaagaagaaaaaaacgaaaacagtcaaccaaccccatcgccaactaagcgaggcatgcctgagagacatggctttcagaaaacgggaagcgctcagaacagtatctttgcactccaatcattcacggagatatgaagagcaactgggacctgagtcaatgcgcaaaatgcagcttgtgtgcaaaagcagtgggctcctggcagaagggagcagcacacgcgttatagtaactcccatcacctctaacacgcacagctgaaagttcttgctcgggtcccttcacctcctcgccctttcttaaagtgcagttcttagccctctagaaacgagttggtgtctttcgtctcagtagcccccaccccaataagctgtagacattggtttacagtgaaactatgctattctcagccctttgaaactctgcttctcctccagggcccgattcccaaaccccatggcttccctcacactgtcttttctaccattttcattatagaatgcttccaatcttttgtgaattttttattataaaaaatctatttgtatctatcctaaccagttcggggatatattaagatatttttgtacataagagagaaagagagagaaaaatttatagaagttttgtacaaatggtttaaaatgtgtatatcttgatactttaacatgtaatgctattacctctgcatattttagatgtgtagttcaccttacaactgcaattttccctatgtggttttgtaaagaactctcctcataggtgagatcaagaggccaccagttgtacttcagcaccaatgtgtcttactttatagaaatgttgttaatgtattaatgatgttattaaatactgttcaagaagaacaaagtttatgcagctactgtccaaactcaaagtggcagccagttggttttgataggttgccttttggagatttctattactgcctttttttttcttactgttttattacaaacttacaaaaatatgtataaccctgttttatacaaactagtttcgtaataaaactttttcctttttttaaaatgaaaataaaaaaaa

SEQ ID NO: 44 - DNA, 1864 bp, Homo sapiens
ctggcggctcttgggactggcggggctgcgcgcggggttagggtgggggtacgggaaggctcaacccaggacctgcgtaccttgctttgggggcgcactaagcacctgccgggagcagggggcgcaccgggaactcgcagatttcgccagttgggcgcactggggatctgtggactgcgtccgggggatgggctagggggacatgcgcacgctttgggccttacagaatgtgatcgcgcgagggggagggcgaagcgtggcgggagggcgaggcgaaggaaggagggcgtgagaaaggcgacggcggcggcgcggaggagggttatctatacatttaaaaaccagccgcctgcgccgcgcctgcggagacctgggagagtccggccgcacgcgcgggacacgagcgtcccacgctccctggcgcgtacggcctgccaccactaggcctcctatccccgggctccagacgacctaggacgcgtgccctggggagttgcctggcggcgccgtgccagaagcccccttggggcgccacagttttccccgtcgcctccggttcctctgcctgcaccttcctgcggcgcgccgggacctggagcgggcgggtggatgcaggcgcgatggacggcggcacactgcccaggtccgcgccccctgcgccccccgtccctgtcggctgcgctgcccggcggagacccgcgtccccggaactgttgcgctgcagccggcggcggcgaccggccaccgcagagaccggaggcggcgcagcggccgtagcgcggcgcaatgagcgcgagcgcaaccgcgtgaagctggtgaacttgggcttccaggcgctgcggcagcacgtgccgcacggcggcgccagcaagaagctgagcaaggtggagacgctgcgctcagccgtggagtacatccgcgcgctgcagcgcctgctggccgagcacgacgccgtgcgcaacgcgctggcgggagggctgaggccgcaggccgtgcggccgtctgcgccccgcgggccgccagggaccaccccggtcgccgcctcgccctcccgcgcttcttcgtccccgggccgcgggggcagctcggagcccggctccccgcgttccgcctactcgtcggacgacagcggctgcgaaggcgcgctgagtcctgcggagcgcgagctactcgacttctccagctggttagggggctactgagcgccctcgacctatgagcctcagccccggaagccgagcgagcggccggcgcgctcatcgccggggagcccgccaggtggaccggcccgcgctccgcccccagcgagccggggacccacccaccaccccccgcaccgccgacgccgcctcgttcgtccggcccagcctgaccaatgccgcggtggaaacgggcttggagctggccccataagggctggcggcttcctccgacgccgcccctccccacagcttctcgactgcagtggggcggggggcaccaacacttggagatttttccggaggggagaggattttctaagggcacagagaatccattttctacacattaacttgagctgctggagggacactgctggcaaacggagacctatttttgtacaaagaacccttgacctggggcgtaataaagatgacctggacccctgcccccactatctggagttttccatgctggccaagatctggacacgagcagtccctgaggggcggggtccctggcgtgaggcccccgtgacagcccaccctggggtgggtttgtgggcactgctgctctgctagggagaagcctgtgtggggcacacctcttcaagggagcgtgaactttataaataaatcagttctgtttaaaaaaaaaaaaaaaa

SEQ ID NO: 45 - DNA, 650 bp, Homo sapiens
ttaagtccaactcagcccaaaatacagcatcctgacgacaaaactcaggttaaagaggaaatgatggacaacagaggcaactctagtctacctgacaaacttcctatcttccctgattctgcccgcttgccactgaccaggtccttctatctggagcccatggtcactttccacgtgcacccagaggccccggtgtcatccccttactctgaggagctgccacggctgccttttcccagcgactctcttatcctgggaaattacagtgaaccctgccccttctctttcccgatgccttatccaaattacagagggtgcgagtactcctacgggccagccttcacccggaaaaggaatgagcgggaaaggcagcgggtgaaatgtgtcaatgaaggctatgcccagctccgccatcatctgccagaggagtatttggagaagcgactcagcaaagtggaaaccctcagagctgcgatcaagtacattaactacctgcagtctcttctgtaccctgataaagctgagaccaagaataaccctggaaaagtttcctccatgatagcaaccaccagccaccatgctgaccctatgttcagaattgtttgagttgctgtttccaaatagaaatgaataatatcacaaaatggggt

SEQ ID NO: 46 - DNA, 11784 bp, Homo sapiens
aggagtggaaggttgaggggggcgctaggcgcccttcgctccctccctctggaggagctgccgccgccaccgccgccactctgctgctgccgccgccgccgccgccgctcccgccgccattttgggttcgctttgcggaggggagacgatcccagtctcggttgcgggacccgcctcccctcagtttgccccctttagccttccacctttcccttctcctctctcgcatttccgccagtcagcttacccgctggccgcctcctgacaagcgggagggatccgccgtggacccagggaagcggaggagcctggcggccaccccctcttccccacttccctgcactctcatcgctctcggcctcggcctcggcctccgacacgagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatactattactccttcagttgttaacttcactagtttatttagtaataagccttttttaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtctccaaaagggctagaattagaaagatcagagctttttaaaaacgtttcatgtagctcactatcaaatagtaattctgagccagccaagtttatgaaaaacattggacccccttcatttgtagatcatgacttccttaaacgccgattgccaaagttgagcaaatccacagctccatctcttgctctcttagctgatagtgaaaaaccatctcataagtcttttgctactcacaaactatcctccagtatgtgtgtctctagtgaccttttgtctgatatttataagcccaaaagaggaaggcctaaatctaaggagatgcctcaactggaagggccacctaaaaggactttaaaaatccctgcttctaaagtgttttctttacagtctaaggaagaacaagaacccccaattttacagccagaaattgaaatcccttccttcaaacaaggtctgtctgtgtctccttttccaaaaaagagaggcaggcctaagaggcaaatgaggtcaccagtcaagatgaagccacctgtactgtcagtggctccatttgttgccactgaaagtccaagcaagctagaatctgaaagtgacaaccatagaagtagcagtgatttctttgagagcgaggatcaacttcaggatccagatgacctagatgacagtcataggccaagtgtctgtagtatgagtgaccttgagatggaaccagataaaaaaattaccaagagaaacaatggacaattaatgaaaacaattatccgcaaaataaataaaatgaagactttaaagagaaagaaactgttgaatcagattctttcaagttctgtagaatcaagtaataaagggaaagtgcaatccaaactccataatacggtatcaagtcttgctgccacatttggctctaaattgggccaacagataaatgtcagcaagaaaggaaccatttatataggaaagagaagaggtcgcaaaccaaaaactgtcttaaatggtattctttctggtagtcctactagccttgctgttcttgagcaaacagctcaacaggcagctgggtcagcattaggacagattcttcccccattactgccttcatctgctagtagttctgagattcttccatcacctatttgctctcagtcttctgggactagtggaggtcagagccctgtaagtagtgatgcaggttttgttgaacccagttcagtgccatatttgcatttacactccagacagggcagtatgattcagactcttgcaatgaagaaggcctcaaaggggaggaggcggttatctcctcctactttgttgccaaattctccttcgcacttgagtgaactcacatctctaaaagaagctactccttccccaatcagtgagtctcatagtgatgagaccattcccagtgatagtggaattggaacagataataacagcacatcagacagggcagagaaattttgtgggcaaaaaaagaggaggcattcttttgagcatgtttctctgattccccctgaaacctctacagtgctaagcagtcttaaagaaaaacataaacacaaatgtaagcgcaggaatcatgattacctcagctatgacaagatgaaaaggcagaaacgaaaacggaaaaagaaatatccccagcttcgaaatagacaggatccagactttattgcagagctggaggaactaataagtcgcctaagtgaaattcggatcactcatcgaagtcatcattttatcccccgagatcttctgccaactatctttcgaatcaactttaatagtttctatacacatccttctttccccttagaccctttgcactacattcgaaaacctgacttaaaaaagaaaagagggagaccccctaagatgagggaggcaatggctgaaatgccttttatgcacagccttagttttcctctttctagtactggattctatccatcttatggtatgccttactctccttcaccccttacagctgctcccataggattaggttactatggaaggtatcctcccactctttatccacctcctccatctccttctttcaccacgccacttccacctccttcctatatgcatgctggtcatttacttctcaatcctgccaaataccataagaaaaagcataagctacttcgacaggaggcctttcttacaaccagcaggactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggctcccagccaacctctgataaaccctcccagcggccatcagagagcacaaattgtagccctacccggaaaaggtcttcatctgagagtacttcttcaacagtaaacggagttccctctcgaagtccaagattagttgcttctggggatgactctgtggatagtctgctgcagcggatggtacaaaatgaggaccaagagcccatggagaaaagtattgatgctgtgattgcaactgcctctgcaccaccttcttccagtccaggccgtagccacagcaaggaccgaaccctgggaaaaccagacagccttttagtgcctgcagtcacaagtgactcttgcaataatagcatctcactcctatctgaaaagttgacaagcagctgttccccccatcatatcaagagaagtgtagtggaagctatgcaacgccaagctcggaaaatgtgcaattacgacaaaatcttggccacaaagaaaaacctagaccatgtcaataaaatcttaaaagccaaaaaacttcaaaggcaggccaggacagggaataactttgtgaaacgtaggccaggtcgacctcggaaatgtccccttcaggctgtcgtatcaatgcaagcattccaggctgctcagtttgtcaacccagaattgaacagagacgaggaaggagcagcactgcacctcagtcctgacacagttacagatgtaattgaggctgttgttcagagtgtaaatctgaacccagaacataaaaaggggttgaagagaaaaggttggctattggaagaacagaccagaaaaaagcagaagccattaccagaggaagaagagcaagagaataataaaagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagacccaaagagtcgattgatccaattaaagaaagagaagctggagtatactccaggagagcatgaatatggattatttccagcgcccattcatgttggaaagtatctaagacaaaagagaattgacttccagcttccttatgatatcctttggcagtggaaacacaatcagctatacaaaaagccagatgtcccactatataagaaaattcgttcaaatgtctacgttgatgtcaaacccctttctggttacgaagctaccacctgtaactgtaagaagccagatgatgacaccaggaagggctgtgttgatgactgcctcaatagaatgatctttgctgagtgttcccccaacacttgcccatgtggcgagcaatgctgtaaccagaggatacagaggcatgaatgggtgcaatgtctagaacgatttcgagctgaggaaaaaggttggggaatcagaaccaaagagcccctaaaagctgggcagttcatcattgaatacctaggggaggtcgtcagtgaacaggagttcaggaacaggatgattgagcagtatcataatcacagtgaccactactgcctgaacctggatagtgggatggtgattgacagttaccgcatgggaaatgaggcccgattcatcaaccatagctgtgacccaaattgtgaaatgcagaaatggtctgttaatggagtataccggattggactctatgctcttaaagacatgccagctgggactgaactcacttatgattataactttcattccttcaatgtggaaaaacagcaactttgtaagtgtggctttgagaaatgtcgaggaatcatcggaggcaagagtcagcgtgtgaatggactcaccagcagcaaaaacagccagcccatggccacacacaaaaaatctggacggtcaaaagagaagagaaagtctaagcacaagctgaagaaaaggagaggccatctctctgaggaacccagtgaaaatatcaacaccccaactagattgaccccccaattacagatgaagccaatgtccaatcgtgaaaggaactttgtgttaaagcatcatgtattcttggtccgaaactgggagaagattcgtcaaaaacaggaggaagtaaagcacaccagtgataatattcactcagcatcattatatacccgttggaatgggatctgccgagatgatgggaatatcaagtctgatgtcttcatgacccagttctctgccctgcagacagctcgatctgttcgaacaagacggttggcagctgcagaggaaaatattgaagtggctcgggcagcccgcctagcccagatcttcaaagaaatttgtgatggtatcatctcttataaagattcttcccggcaagcactggcagctccacttttgaaccttcccccaaagaaaaagaatgctgattattatgagaagatctctgatcccctagatcttatcaccatagagaagcagatcctcactggttactataagacagtggaagcttttgatgctgacatgctcaaagtctttcggaatgctgagaagtactatgggcgtaaatccccagttgggagagatgtttgtcgtctacgaaaggcctattacaatgcccggcatgaggcatcagcccagattgatgagattgtgggagagacagcaagtgaggcagacagcagtgagacctcagtctctgaaaaggagaatgggcatgagaaggacgacgatgttattcgctgtatctgtggcctctacaaggatgaaggtctcatgatccagtgtgacaagtgcatggtatggcagcactgtgattgtatgggagtgaactcagatgtggagcactacctttgtgagcagtgtgacccaaggcctgtggacagggaggttcccatgatccctcggccccactatgcccaacctggctgtgtctacttcatctgtttgctccgagatgacttgctgcttcgtcagggtgactgtgtgtatctgatgagggatagtcggcgcacccctgatggccacccggtccgtcagtcctatcgactgttatctcacattaaccgagataaacttgacatctttcgcattgagaagctttggaagaatgaaaaagaggaacggtttgcctttggtcaccattatttccgtccccacgaaacacaccactctccatcccgtcggttctatcataatgaactatttcgggtgccactctatgagatcattcccttggaggctgtagtggggacctgctgtgtgttggacctttatacgtattgtaaagggagacccaaaggagtaaaggagcaagatgtgtacatctgtgattatcggcttgacaagtcagcacacctgttttacaagatccaccggaaccgctatcctgtctgcaccaaaccctatgcttttgatcacttccccaagaagctcactcccaaaaaagatttctcgcctcattacgtcccagacaactacaagaggaatggaggacgatcatcctggaagtctgagcgctcaaagccacccctaaaagacttgggccaggaggatgatgctctacccttgattgaagaggttctagccagtcaagagcaagcagccaatgagatacccagcctggaggagccagaacgggaaggggccactgctaacgtcagtgagggtgaaaaaaaaacagaggaaagtagtcaagaaccccagtcaacctgtacccctgaggaacgacggcataaccaacgggaacgactcaaccagatcttgctcaatctccttgaaaaaatccctggaaaaaatgccattgatgtgacctacttgctggaggaaggatcaggcaggaaactgcgaaggcgtactttgtttatcccagaaaacagctttcgaaagtgaccctcaaagaatgagaacctcaagcatctgggatccagtggagctaatcagtcctgcctcctgctctctgggtatagacaggggtgggaagggtccatctgggcaaggggaatggggccatgttgttgacattaggtacttaataagccttggagctagtggagagggagaggaaagggttctgtccaagacagttcaggttaattaattttcttctccattgcttcaccttaagggttaataatgtagagaggagggaggaccacattgatgaccagaacctactggtactttatagcatttgccccaccccacagcttaggtttttctgtcatcctcagatcccacaggcattgcgaagaagctgcttcctatacccaggtataactcaaaatccaaagggatagggccaggatccctattcctaccccatctattctctgttggctccaagagctaccccagagaccttaaacagaaacagtagctgaggcttcttcctagatacctgactagggaagtttgtctctcctttcttgcccaaccaggtcaaagtaaaatgtgagttgacagctcaaagcacttgtaactgctgccccctccctacctctactccccaaaatggaatcatgggatagggaaggcccccatggggtcagaagggcacggtagttcttgcaattatttttgttttacccttcataacctgtcaaacatatttttttctaatgagaaagccaggcccccgccagcacacatgctgtttttaatgcgctgtagttcttgtgtgtctgctgtgctgtgcaaatggagattcagttcaaaataaaatcatttaaaaacctacataaaaagaactctaaacccacccctgcaacaaaagtcactacataaactgttcagcagtattcacctatcagagtatttgttgtgagtatagattatcaattgaaaacactactcttgttttcttaattgtacagttttcaatgtccctttcttaaagagacagtatatttctcttcacccctagcccatcttccctcaccctcctgaatgacatcaggaggtatatccagggtgtctccttccttcctactctcttgaccagaagttaacagactatactgtctctttaaaaataaaatttaaaaagctttgttgtcttttcagacatacatatgcatatatgttttagatgttcttataagagaaaagatggtttttaaatgtgccaagttgtgtgtgtgtgtgtatatatatgtgtgtatgtgtgtgtatatatatatgtgtgtgtgtatatatatacacacacacacacacacctgctgtgtgattggtaagcaatacaatagtaaacatgtccccattacttttttctaatattggaccaatgctgtcctaattgtacatttccccttatggtgacgatgctctgactcgtttaggtagacacattgaccaccttccattccattaaatattttttcctttttcccctttctgtgtcattcttgaggaaaaaacaaaagagagaggggatgccaatgatccccttgagcagagaaaaagcaaaataaatattttattaaagaaaaaagagaattaagaaaatagtttggagtattttcttactgtagagaagcactgtacattactaagagacctgggtataagatactcacatgtggagctggaaaaatcgcatgtccaagcccgtttgagtggtttcttttgtttttcattgcagggagtgggtgggagggaggtgggactaggggcactttgggggtctccttttagtcaaaagcgagaaaatgacaagaaagagattaaaattcaatgtttcctttatagtgttaaacactaaaattttaaaaaagatgaaaaagaaaaaaaaactttgtaaaatgcgagaacagaagcaaaagacactacgctctgtcattttatctttcttttgttgaaagactaaaaaaaaactgaaatgttttttagacaatcaaatgttaggtaagtgcaaaaacttgttttttcttactggtgtagaaattaatgcctttttttatttttcagttattttataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattggatgtaattgcatacaaagcttgcatctcaatccttgaaagtctagtattaaatggaaaaaacttttcctaactgtggaaaaaaaaaaa

SEQ ID NO: 47 - DNA, 2599 bp, Homo sapiens
cacagcaacgcgcgcgagagaagagagtattctcgcgagaagtccaggggtggccgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaaaggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagtttatgtgacaaaaaaaaaaaaaaaa

SEQ ID NO: 48 - DNA, 16064 bp, Homo sapiens
ccgcgcgtccctgtgcgtccccgggtccctgcgggcgggcgggcgcggtcgccgccgagcaacccggcctgcgcccggcacgactgtagatgtcaggctttgcccggggagccgagcggcagcggggctgtgagtttcaaattaaccttccgctttgttgctgtgtaatgtggatccccgaaggccccccgccccgcccgccccccttccccgggcggtgcgcgctgcaaactgcgagttgggcttcatttacataaagcgattccgggcgggcggcggcagaggaggaggcggcggcggcgggcaggccggggacccggacgccagcgccgcgccccgtgggtgaatccccgccgcgtcccggggacctccctccggggacgggccgaccgccagccctgccgccaccatgagctcccctcccctgtctccgggccccctgctcctgaccagagccacctccgagtcctggggccagcgggaggtggggagcatgccgcctggggtgggtgagctcggggctcgggtgccactggaatttcccgttgttgcgcatggcggcgcggcccccggacctgcaagtgccgcctccctccggaggtgcgcggaggcttggtgtgccaggtccgagcctccgtactgggtgcaatgaaagctccacgcaggccttaccatggaaggctgtgactcgcccgtcgtctcggggaaggacaatgggtgcggtatccctcagcaccagcaatggactgaactcaacagcacccacctccctgacaaacccagtagcatggagcagtccacaggcgagagccacgggcccttggacagcctgagggcccccttcaatgagcgcctcgcggagagcaccgcgtcggccgggcccccctccgagcccgccagcaaggaggtcacctgcaacgaatgttcggcctcctttgccagcctccagacctacatggagcaccactgccccagcgcgcgccccccgccacccctgagagaggagagcgccagcgacaccggtgaggagggggacgaggagagtgacgtggagaacctggccggggagatcgtctaccagccggacggctccgcgtacattgtggagagcctgagccagctgacccagggcgggggcgcctgtgggagtggcagtggcagtgggcctctcccctcgcttttcctgaactctctccctggcgcggggggcaagcaaggggacccttcgtgtgctgcacccgtgtacccgcagatcatcaacactttccacatagcctcatccttcgggaaatggtttgagggcccagaccaggctttcccgaatacctcagccctggcggggctcagccccgtcctgcacagcttccgcgtgtttgacgtgcgacacaaaagcaacaaggattacctgaacagcgacggttctgccaaaagctcctgcgtatccaaagatgttcccaacaatgtggacctgtccaaattcgatggctttgtgctctatggcaagaggaagcccatcctgatgtgtttcttgtgcaaactctcctttgggtacgtccgttcgtttgtgacccacgcggtgcatgaccatcgaatgaccctgagcgaagacgagcggaaaattcttagcaataagaacatctccgctatcatccaagggatcggcaaagacaaggaaccccttgtaagttttctggaaccaaaaaacaaaaactttcaacaccctttagtttccacagctaacctcataggccccggacacagtttttatggtaaatttagtggcattcgaatggaaggggaggaagctctcccagcgggctccgccgctggccccgagcagccccaggctggtctcttgacccccagcaccctgttgaaccttggcgggctcaccagctcggtactgaagacccccattacctcagtccccctggggcctctggcttccagtcctaccaaatcctcagagggcaaggactctggggcggcagaaggagagaagcaggaagtgggcgacggggattgcttctctgagaaggtagagccagccgaagaggaggcggaggaggaagaggaggaggaagaggcggaggaggaggaggaagaagaggaggaggaagaagaggaggaggaagacgagggttgcaaaggactctttccaagcgagttggatgaggaactggaggacaggccccatgaggagcctggggccgcagcaggtagtagcagcaaaaaggaccttgctctctcaaaccaaagcatttctaactcccccttaatgcctaacgtgctccagaccctgtcgaggggcacagcttctactagttctaattctgcttcttcctttgttgtctttgatggtgcgaacaggaggaatcgtttaagctttaacagtgagggcgtcagggccaatgtggcagagggcggcaggaggctggacttcgctgacgaaagtgccaataaagacaatgccacagcaccagaaccaaatgaaagcacagagggtgacgatgggggcttcgttccccatcaccagcacgctggctccctctgcgagcttggggttggggagtgcccctcggggagtggcgtggagtgccccaaatgcgacacggtcctgggctcctcccgctcgctgggcggccacatgaccatgatgcattctcgtaactcgtgtaagacactcaagtgccccaagtgcaactggcactataagtaccagcagaccctggaggcacacatgaaggagaagcacccggagccggggggctcctgtgtctactgcaaaagcgggcagccccacccccggctggcacgaggcgagagctacacgtgtggttacaagcctttccgctgcgaggtgtgtaactactccacaactaccaaaggcaacctcagtattcatatgcagtctgacaagcatctcaacaacatgcagaacctgcagaatggagggggggagcaggtcttcagccacactgccggggcggcggcggcggcggtggctgcggcggcggcggcagccaatatcagtagctcctgcggggccccctcgccgaccaaaccaaaaaccaaacccacctggcggtgcgaggtgtgtgattatgagaccaacgtggccaggaacctccgcattcacatgaccagtgagaagcacatgcataacatgatgttactgcaacagaacatgacccagatccaacacaaccgccacctgggcctcggcagcctgccctcacccgccgaggccgagctctaccaatactacctggcccagaacatgaacctgcccaacctgaagatggacagtgctgcctcggacgcccagttcatgatgagcggattccagctggatcccgccgggcccatggccgccatgacgcctgctctagtgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaagcacctgcagcagcatgagagtggtgtagaaggtgagagctgctactaccactgcgttctgtgcaactactccaccaaggccaagctcaacctcatccagcatgtgcgctccatgaagcaccagcgaagcgagagcctgcgaaagctgcagcggctgcagaagggccttccagaggaggacgaggacctggggcagatcttcaccatccgcaggtgcccctccacggacccagaagaagccattgaagatgttgaaggacccagtgaaacagctgctgatccagaggagcttgctaaggaccaagagggcggagcatcgtccagccaagcagagaaggagctgacagattctcctgcaacctccaaacgcatctccttcccaggtagctcagagtctcccctctcttcgaagcgaccaaaaacagctgaggagatcaaaccggagcagatgtaccagtgtccctactgcaagtacagtaatgccgatgtcaaccggctccgggtgcatgccatgacgcagcactcggtgcaacccatgcttcgctgccccctgtgccaggacatgctcaacaacaagatccacctccagctgcacctcacccacctccacagcgtggcacctgactgcgtggagaagctcattatgacggtgaccacccctgagatggtgatgccaagcagcatgttcctcccagcagctgttccagatcgagatgggaattccaatttggaagaggcaggaaagcagcctgaaacctcagaggatctgggaaagaacatcttgccatccgcaagcacagagcaaagcggagatttgaaaccatcccctgctgacccaggctctgtgagagaagactcaggcttcatctgctggaagaaggggtgcaaccaggttttcaaaacttctgctgcccttcagacgcattttaatgaagtgcatgccaagaggcctcagctgccggtgtcagatcgccatgtgtacaagtaccgctgtaatcagtgtagcctggccttcaagaccattgaaaagttgcagctccattctcagtaccatgtgatcagagctgccaccatgtgctgtctttgtcagcgcagtttccgaactttccaggctctgaagaagcaccttgagacaagccacctggagctgagtgaggctgacatccaacagctttatggtggcctgctggccaatggggacctcctggcaatgggagaccccactctggcagaggaccataccataattgttgaggaagacaaggaggaagagagtgacttggaagataaacagagcccaacgggcagtgactctgggtcagtacaagaagactcgggctcagagccaaagagagctctgcctttcagaaaaggtcccaattttactatggaaaagttcctagacccttctcgcccttacaagtgtaccgtctgcaaggaatctttcactcaaaagaatatcctgctagtacactacaattctgtctcccacctgcataagttaaagagagcccttcaagaatcagcaaccggtcagccagaacccaccagcagcccagacaacaaaccttttaagtgtaacacttgtaatgtggcctacagccagagttccactctggagatccatatgaggtctgtgttacatcaaaccaaggcccgggcagccaagctggaggctgcaagtggcagcagcaatgggactgggaacagcagcagtatttccttgagctcctccacgccaagtcctgtgagcaccagtggcagtaacacctttaccacctccaatccaagcagtgctggcattgctccaagctctaacttactaagccaagtgcccactgagagtgtagggatgccacccctggggaatcctattggtgccaacattgcttccccttcagagcccaaagaggccaatcggaagaaactggcagatatgattgcatccaggcagcagcaacaacagcagcagcaacagcaacaacaacaacaacaacaacaacaacaagcacaaacgctggcccaggcccaggctcaagttcaagctcacctgcagcaggagctgcagcaacaggctgccctgatccagtctcagctgtttaaccccaccctccttcctcacttccccatgacaactgagaccctgctgcaactacagcagcagcagcacctcctcttccctttctacatccccagtgctgagttccagcttaaccccgaggtgagcttgccagtgaccagtggggcactgacactgactgggacaggcccaggcctgctggaagatctgaaggctcaggttcaggtcccacagcagagccatcagcagatcttgccgcagcagcagcagaaccaactctctatagcccagagtcactctgccctccttcagccaagccagcaccccgaaaagaagaacaaattggtcatcaaagaaaaggaaaaagaaagccagagagagagggacagcgccgaggggggagagggcaacaccggtccgaaggaaacactgccagatgccttgaaggccaaagagaagaaagagttggcaccagggggtggttctgagccttccatgctccctccacgcattgcttcagatgccagagggaacgccaccaaggccctgctggagaactttggctttgagttggtcatccagtataatgagaacaagcagaaggtgcagaaaaagaatgggaagactgaccagggagagaacctggaaaagctcgagtgtgactcctgcggcaagttgttttccaacatcttgattttaaagagtcatcaagagcacgttcatcagaattactttcctttcaaacagctcgagaggtttgccaaacagtacagagaccactacgataaactgtacccactgaggccccagaccccagagccaccaccacctccccctccaccccctccacccccacttccggcagcgccgcctcagccggcgtccacaccagccatccccgcatcagccccacccatcacctcacctacaattgcaccggcccagccatcagtgccgctcacccagctctccatgccgatggagctgcccatcttctcgccgctgatgatgcagacgatgccgctgcagaccttgccggctcagctacccccgcagctgggacctgtggagcctctgcctgcggacctggcccaactctaccagcatcagctcaatccaaccctgctccagcagcagaacaagaggcctcgcaccaggatcacagatgatcagctccgagtcttgcggcaatattttgacattaacaactcccccagtgaagagcaaataaaagagatggcagacaagtccgggttgccccagaaagtgatcaagcactggttcaggaacactctcttcaaagagaggcagcgtaacaaggactccccttacaacttcagtaatcctcctatcaccagcctggaggagctcaagattgactcccggcccccttcgccggaacctccaaagcaggagtactggggaagcaagaggtcttcaagaacaaggtttacggactaccagctgagggtcttacaggacttcttcgatgccaatgcttacccaaaggatgatgaatttgagcaactctctaatttactgaaccttccaacccgagtgatagtggtgtggtttcagaatgcccgacagaaggccaggaagaattatgagaatcagggagagggcaaagatggagagcggcgtgagcttacaaatgatagatacattcgaacaagcaacttgaactaccagtgcaaaaaatgtagcctggtgtttcagcgcatctttgatctcatcaagcaccagaagaagctgtgttacaaggatgaggatgaggaggggcaggacgacagccaaaatgaggattccatggatgccatggaaatcctgacgcctaccagctcatcctgcagtaccccgatgccctcacaggcttacagcgccccagcaccatcagccaataatacagcttcctccgctttcttgcagcttacagcggaggctgaggaactggccaccttcaattcaaaaacagaggcaggcgatgagaaaccaaagctggcggaagctcccagtgcacagccaaaccaaacccaagaaaagcaaggacaaccaaagccagagctgcagcagcaagagcagcccgagcagaagaccaacactccccagcagaagctcccccagctggtgtccctgccttcgttgccacagcctcctccacaagcgccccctccacagtgccccttaccccagtcgagccccagtccttcccagctctcccacctgcccctcaagcccctccacacatcaactcctcaacagctcgcaaacctacctcctcagctaatcccctaccagtgtgaccagtgtaagttggcatttccgtcatttgagcactggcaggagcatcagcagctccacttcctgagcgcgcagaaccagttcatccacccccagtttttggacaggtccctggatatgcctttcatgctctttgatcccagtaacccactcctggccagccagctgctctctggggccatacctcagattccagcaagctcagccacttctccttcaactccaacctccacaatgaacactctcaagaggaagctggaggaaaaggccagtgcaagccctggcgaaaacgacagtgggacaggaggagaagagcctcagagagacaagcgtttgagaacaaccatcacaccggaacaactagaaattctctaccagaagtatctactggattccaatccgactcgaaagatgttggatcacattgcacacgaggtgggcttgaagaaacgtgtggtacaagtctggtttcagaacacccgagctcgggaaaggaaaggacagttccgggctgtaggcccagcgcaggcccacaggagatgccctttttgcagagcgctcttcaaagccaagactgctcttgaggctcatatccggtcccgtcactggcatgaagccaagagagctggctacaacctaactctgtctgcgatgctcttagactgtgatgggggactccagatgaaaggagatatttttgacggaactagcttttcccacctacccccaagcagtagtgatggtcagggtgtccccctctcacctgtgagtaaaaccatggaattgtcacccagaactcttctaagcccttcctccattaaggtggaagggattgaagactttgaaagcccctccatgtcctcagttaatctaaactttgaccaaactaagctggacaacgatgactgttcctctgtcaacacagcaatcacagataccacaactggagacgagggcaacgcagataacgacagtgcaacgggaatagcaactgaaaccaaatcctcttctgcacccaacgaagggttgaccaaagcggccatgatggcaatgtctgagtatgaagatcggttgtcatctggtctggtcagcccggccccgagcttttatagcaaggaatatgacaatgaaggtacagtggactacagtgaaacctcaagccttgcagatccctgctccccgagtcctggtgcgagtggatctgcaggcaaatctggtgacagcggagatcggcctgggcagaaacgttttcgcactcaaatgaccaatctgcagctgaaggtcctcaagtcatgctttaatgactacaggacacccactatgctagaatgtgaggtcctgggcaatgacattggactgccaaagagagtcgttcaggtctggttccagaatgcccgggcaaaagaaaagaagtccaagttaagcatggccaagcattttggtataaaccaaacgagttatgagggacccaaaacagagtgcactttgtgtggcatcaagtacagcgctcggctgtctgtacgtgaccatatcttttcccaacagcatatctccaaagttaaagacaccattggaagccagctggacaaggagaaagaatactttgacccagccaccgtacgtcagttgatggctcaacaagagttggaccggattaaaaaggccaacgaggtccttggactggcagctcagcagcaagggatgtttgacaacacccctcttcaggcccttaaccttcctacagcatatccagcgctccagggcattcctcctgtgttgctcccgggcctcaacagcccctccttgccaggctttactccatccaacacagctttaacgtctcctaagccgaacttgatgggtctgcccagcacaactgttccttcccctggcctccccacttctggattaccaaataaaccgtcctcagcgtcgctgagctccccaaccccagcacaagccacgatggcgatgggccctcagcaacccccccagcagcagcagcagcagcagcaaccacaggtgcagcagcctcccccgccgccagcagcccagccgccacccacaccacagctcccactgcaacagcagcagcaacgcaaggacaaagacagtgagaaagtaaaggagaaggaaaaggcacacaaagggaaaggggaacccctgcctgtccccaagaaggagaaaggagaggcccccacggcaactgcagccacgatctcagccccgctgcccaccatggagtatgcggtagaccctgcacagctgcaggccctgcaggccgcgttgacttcggaccccacagcattgctcacaagccagttccttccttactttgtaccaggcttttctccttattatgctccccagatccctggcgccctgcagagcgggtacctgcagcctatgtatggcatggaaggcctgttcccctacagccctgcactgtcgcaggccctgatggggctgtccccaggctccctactgcagcagtaccagcaataccagcagagtctgcaggaggcaattcagcagcagcagcagcggcaactacagcagcagcagcagcaaaaagtgcagcagcagcagcccaaagcaagccaaaccccagtcccccccggggctccttccccagacaaagaccctgccaaagaatcccccaaaccagaagaacagaaaaacaccccccgtgaggtgtcccccctcctgccgaaactccctgaagagccagaagcagaaagcaaaagtgcggactccctctacgaccccttcattgttccaaaggtgcagtacaagttggtctgccgcaagtgccaggcgggcttcagcgacgaggaggcagcgaggagccacctgaagtccctctgcttcttcggccagtctgtggtgaacctgcaagagatggtgcttcacgtccccaccggcggcggcggcggtggcagtggcggcggcggcggcggtggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagcccccctcccccgtcggccgccgccccctcctccgcttccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaacaaaaaaaaaaaaaaaaagaaaaaaaagaaaaagcgtgggttgttttcccatatacctatctatgccggtgattttacattcttgtctttttcttttcttttaatattaaaaaaaaaaaaaaagccctaaccctgttacattgtgtccttttgaaggtactattggtctgggaaacagaagtccgcagggcctccctaatgtctttggagcttaaaccccttgtatatttgccccttttcaataaacgccccacgctgatagcacagaggagcccggcatgcactgtatgggaaagcagtccaccttgttacagttttaaatttcttgctatcttagcattcagataccaatggcttgctaaaagaaaaaaagaaatgtaatgtctttttattctcaggtcaatcgctcacactttgttttcagaatcattgttttatatattattgttttttcagtttttttttttttttttgttccagaaaagattttttgttttgttaacttaaaaatgggcagaaagtattcaagaaaaacaatgtgaactgctttagctttctggggatttttaaggatagcttttctgctgaagccaatttcaaggggaaaagttaagcactcccactttcaaaaaaaaaaaaaaataataacccacacacacaaagagtgttgaggacttgtagcttaaaaaaaataagttttaaaaactgactttctgtatttatgatagatatgaccatttttggtgttgagtagattgttgcattggaaatgaactgaagcagtatggtagatttaaaaggaaaaaaaaaaaaaaaccttttgtgtacatttagctttttgtatggtccagctgacagctcctcatttgatgttgtcttgttcattcctagcagatgatagattgcaatccgttgattcgcctaagcttttctccccttgtcccttaattccactttctctttcttgtcccttaattccactttctctttccttctcccacctcccgtcctataatctcccacttaaggtagctgccttcatttcttagagggagctgcagaattattttataaaactaaagaaagaatttcaagggattctaggggtcattaggatcctcacagattatttttggttggggagttgaaactttttaaaggcatataattctagttacctgtgtctgttagctttgtgcatttattttttatttatccttcttttggcttttttttctttgtaccccttcttttcctccttgtttggtaggagcttcaaatattctttttttttctatactaaaggatttgtttccatttgtgtaattggctgtgtacttttcttttctaaaaaaagtttttggttagggatttggtttttggttttgtgtttgttttttctttcctctctcagaaaaaaaaatttcatgctttaaataaaatccaaagacacaccctttcactgctgatgcagaaaaaagggaaagggttcttgttacttgagaatttgtttctgatttaaacaaacaagacttagtttaataaaagaaagagaaaaacaaaagattcccaggttgttatgtgcttcttctgcaagcagagaggcaaatgttaatgacaattccatataccaaaagacacattttttacttcaaagttttgtccttgtgttaggcagtctgagcagcgagtgatccagagcgcagccaacaaagcagcagatagcagtgtacagaaagcaaaaaaggaactgtatgtgaggcacttgtttctgttaatatccatattcctgttaacacacaccctttctcatgtaaaaagaaaaataaataaatggtctgaactttgaaaactttgtgctgctaaaacatagattttggagacaaataaatagatgctttgctgtttcactttcatagctaaacatcaacagaaaccatctccccttgcccccaaagtgtgaaatccttcttcccttcgttttcttccttatgtttcaaaagggaactttgaagactgtgaatacaggttccattggtcacctttcgggcttctttccccagtgctgaagccactcatcgactttgcaaaagactggagcattccaagatctgaaaatggattttttttctttttttcttttttagccgggactattttatttttatgaatttgtttttagtttaatgaaatagtagatcctgaaatgttgtacatatttctaactaggctgatgcacagtgcaaattccttttttaattgttttttttaagtagaaatactaaagaaagaataccatctaactattcataccagtatccagttgtagcataaggtgtcaaaagcaagtacgcaaaacatttactgttttaacaagctatttccttttaacaagaaatcttgtatttcttcctgtgtttgagatgaacatttttaaattttaaagttgtacagttttttgttttccattattttatcttgtttgtaactctatgaaatatatatatatatattttttgccatttaactgttgtatgttactctgtgtctgtaccatatagaaaaaaaattgtttttgtttttggttctctatgtgatatcagttaacaatgtaacactagctttacctgtcaaattctgctaggtcttctctgaaaacgttgtttttaaaaatgatattgcttggtaatagtgcaatttctatccttttccctcccccctcaacttttaagttcttttctttataattttgctgccccctccctgatggtttgggtttttgtttttgtttttgtttttttttttcatggagctactatgccatcctccctctgtgaggcagagtgactgtcagtgttttgttatgccatgccttgagctgtgggtgtttggcgacaataaggtggttgaatagattggctgagcacacttccacccacctagtgttctcagaggggttatgtgattgtttcaacctggagtgggttgcacccttaatgctttcctctgcaactaaaccgcccacatatatgttcattgaaaaaagtaagaataattctcagcactaacccagaagtagcaaagcagtcagtgatggtgaacattagaggtcaaacatgagttagatgtttgtgggctgacagccatcgtggctatgaccagtactatttacaaagcatgaattcactacaatgctcaactgtttgtttagctttatctcacttggggaatttattcctgtctgctgcattgtaggtagctgggtaggatatatttccacttgctttttaaattagttcttcacctccattgacactcgttttttggttttctccctatagtgtgggttggtgctagacaccagtctgacccacagaatgggagttatttcatccatctttcctccatccttccaaaaaccacatatctacacaaggaaaaatttaatacatctaggaattttttttttaattacaagctatttaaagagatgaatgtggccaaagttttacacaattgaaaataaagtaaaacagacggcatgtgtttaaacctgagtttatcaggcatggcaggaagttgcaggagagagaggcagtgacccaagccagtgcacttgatgttcatggacatatattttttttaaataataaattaaaacattttaaatagaagcataaattgagttgtttgttggcgctgagatactgcccactgtgaaacaaagctttgactagttttttgtttgtttactttcttcaggggggaggggggcaagtttgggtaggaaagaaagcataaatgaacgtgaccctgaggtgaagaggtatatgaacagcctttgcaatgtacaaaaagaaaaaaaaacaaaaaacaacaaaaaaaatagagcaagtgaaaccaaaaatgatgttcttggtgtttttctataatgtagtcttgttagcttttttgttactgtaacaatgctgatctcgaactgtaccaaaatacatggagactaacaaacagaaccacatggaactttcaaactgaaaaaaaaatttgtcacaaaaactttgttgtcatagttaagttgattgtagatggtaattgaatatactcctttgaaaatatttcatcaagtatgtttcctgctcattgtgatacattaaaaaaaaaatatgagcaaaa

SEQ ID NO: 49 - DNA, 2439 bp, Homo sapiens
agttttgcccccctcccctcccccgcccccgcccccgcccccaggcttgtgtagatcatgccgccagtagcggccctgactgccgaggaaacggtagcttaggacagttggctgttaagtgacactgattctccccgccccgcctgacccccgagaaggaggcttgtcccccgctgcgtgagggggtggggaagtgggtagtgaattcggatctacctgggaggggggagtggaagttcccgccccggagagcggcgaggcggcagccacagttgattatggaagattcccacaagagtaccacgtcagagacagcacctcaacctggttcagcagttcagggagctcacatttctcatattgctcaacaggtatcatctttatcagaaagtgaggagtcccaggactcatccgacagcataggctcctcacagaaagcccacgggatcctagcacggcgcccatcttacagaaaaattttgaaagacttatcttctgaagatacacggggcagaaaaggagacggagaaaattctggagtttctgctgctgtcacttctatgtctgttccaactcccatctatcagactagcagcggacagtacattgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaactgcatcaggagatatgcaaacatatcagatccgaactacaccttcagctacttctctgccacaaactgtggtgatgacatctcctgtgactctcacctctcagacaactaagacagatgacccccaattgaaaagagaaataaggttaatgaaaaacagagaagctgctcgagaatgtcgcagaaagaagaaagaatatgtgaaatgcctggaaaaccgagttgcagtcctggaaaatcaaaataaaactctaatagaagagttaaaaactttgaaggatctttattccaataaaagtgtttgattcctaagaaagaaaatatttttgtggacatgcataaaaattaaatggatttcctagtggagttttataaattaaaaggtcaaaactgaagctttttatttaggcttttccaaatcaaggataaatatcttacgcacgatatctagtgacagaggagaaagtggaaaatgacctcaaggaagctacgggcacaactggaagctttgtagaaattaaacatattcaaggagcaagaaatgaactttcagcagtctaaattttctaaataaccaatagttgccaatctaaaatggcagagaagatgaaatttgataaactgaattttttttaaaaatccatttaccctacaggtttgcatttgtttgctgaaatttacctttttttagttatatatatgtgtgtgtgtgtgtgtaatttctgccaataaattctaaattacaaaggtaagagaaaacctagtacattactaaatatataaagtatatgttctgattatgtatacttgttctagtgtcaagtctttttaagtgggtttttaaaagtttgttattggacttgaatggatttttgagactaggttaattatttttgaggtcttatcctaaaaggcatctaaggtacatgaatggagtatggtgattttataacattttttatcagaatggaaaaagaactgtttaaaagtttgatacttttaaatagttggtttttttgcttactctggtaatgattttctacaaatacataataaattgtttttttgagtctatattctgtatgcagttgaatatccattacttattctgctgtgctttaatagaatggaatgtttacaggcccttaaaatattatttttaaaaaaccttctgaagatacataccaaagtttttccaagaagattttataatcaatttaataatgtaaggtttatcagattctataatagtatagttattaaggcaattttatgttagagactattttgtaatgtagtgagtggtacctttataagaaaagtgactgccaatatatttttatagctgatctttataaattctaatgttgagtttttaatgattattttaaatgtttatatagtttagtaaaatttgcatctcaaagtatcatttttatattatgggacgttttcagattggctaatatttgcattgtaaattttgtatgcagtttatctaaaattcaaaaatactgtcagtacaccagcgtttaacatctatattccaatttgtatacagtttaaaattgtactgcaaaactattgtgtgctcttacacagtatgcatcatattgttgtctgtgaaattaaaggacatttgatagtcta

SEQ ID NO: 50 - DNA, 2117 bp, Homo sapiens
gtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaaaaaaaa

SEQ ID NO: 51 - DNA, 2049 bp, Homo sapiens
cgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 52 - DNA, 2022 bp, Homo sapiens
tttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtgcggcctggggccagggcggtgccgccaagggggaagcgatttaacgagcgcccgggacgcgtggtctttgcttgggtgtccccgagacgctcgcgtgcctgggatcgggaaagcgtagtcgggtgcccggactgcttccccaggagccctacagccctcggaccccgagccccgcaagggtcccaggggtcttggctgttgccccacgaaacgtggcaggaaccaagatggcggcggcagggcggcggcgcgggcgtgagtcaagggcgggcggtgggcggggcgcggccgccctggccgtatttggacgtggggacggagcgctttcctcttggcggccggtggaagaatcccctggtctccgtgagcgtccattttgtggaacctgagttgcaagcagggaggggcaaatacaactgccctgttcccgattctctagatggccgatctagagaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaagta

SEQ ID NO: 53 - DNA, 2268 bp, Homo sapiens
gtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccttaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctggaaaaaaaaa

SEQ ID NO: 54 - DNA, 2488 bp, Homo sapiens
ttttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaacctcagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatgagaatgtgatcaatgggcaggactacgaagtgatgatgcagattgactgtcaggtgatggacaccaggatcctccatatcaaaagttcgtcagttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagcta

SEQ ID NO: 55 - DNA, 405 bp, Homo sapiens
ctgtgtcaggatgctgttgggtagctggctctgtggacaagtggctgtgagtggaactctctctgagagtagctggaaaaaacccaggctccagctccctgaggagacagcgggaagtctcctgactttgtgggccccagctttctgtaggagagggtattaattctgtctctacctgtgagcagcgagggagggtatgtgccagcaccgtgtacagtacagagctgcatcgtgcaaggagtgtgcctccagttgccaggctccacactgcgggctcagcttgcgtggtagcatctccatcttcatcgccagcctggcgacagagcgagactgtctcaaaaaaaaaaaaattctctgtaatagctccaggccaagagttgttgcctcacgccacctaccagattc

SEQ ID NO: 56 - DNA, 1709 bp, Homo sapiens
aaacagcggacggaggggccggcggtggcggagccggagcaagcaggggttcggcggcattacctgtacccattcaccggcggctaccggcggcggcgcgcagcgtgtcaggcggagagacccgccgccaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaattaaatgaaaaaaaaaaaaaaaaaaaaaaaaaaaaa

SEQ ID NO: 57 - DNA, 1381 bp, Homo sapiens
tactgaagcagcatttgaagctgcagtcttgaaacacatgcaggctggaaaagtcgctaaagaattacttatttgagatggcacatgtttctgcagaaactcaagatgtttctcctaaagatgaatcaactggttcaaaagcctcctctgggtctccattgtgtgaacacataatccctggggattcagacttaaggtcaatgactgaatcaatgattttcaggttttgccacaaggatccttgataaaaaggccacattatactttatgtctctgagccagataaagataatgattttccttctctgacctttcccagtaaactttggaaaatagctgaaagtgaccaattcaagtctaattcataggataagaatgaaacttgcatagtgactaatgaagaactcttcaagaaagaaaatttggaaataaaggctccttacagaatatttcaaactgacagtatgaaaatcttaatttgacagctcaacctttatggatttagtaaaattcaacagaattttcacagatctgcttttctagccaactttctggcagaagaaaaagaaatttctgttttaagcaagttaaagttgtattatcatccgaatttcaaacgtggctgtccccaacttttaataagaacgaaaagaagaattaagattaaaaacacttctcttgtatctacttcactgaatatttcaagaaacactttagagcaggggctaacacagataaacataattctgtcttagctgctgaaactagtgaagaaagttcattttcaacatctacaaatttaaatatgactctaacaaggaaatcttctgtcagccagggcattgctggttcacctgacccaattagaagtggtttccctcctcttccatttcaacctcagttggacaatcagaacaaattacaacaaatcaacatgctattttaaatcaattgacaaatattcatatgcactctcatagcaccgacatgtaagcaaatggccacgttgtgaattttgttacaaccacagcttctcaatactacatcatatctccctcctttggggctgatagtgaaaccacctactttttcccaccagatatcctgaggtattagccaatgaggctcctcattctaacctgctaccagcaggcaacctgtggttgtaaatgactgcgacagctgatacatcagttgcctttcgttacaggccagctcttcaaccatctttactggaaaaatatcaccctagttacaactgatcttccaccaaaagagtaccagattatgcatgacaacagagactgaaatttatgttgacaagaacattaaaaattcctgcaataatcttactgaacaataaaattacatgttgaccttt

SEQ ID NO: 58 - DNA, 5642 bp, Homo sapiens
cgcccgccgggcgctctcgcttcagtcagtcgggccgcgccgcgcctcagctctggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctgcaaagtgaaaaggagagcttgttgaaggaaagagatcacattttgtcaactctgggtgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccataagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacacccaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgttcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtagaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaaa

SEQ ID NO: 59 - DNA, 9215 bp, Homo sapiens
aaacagcgccgagccgccgccgcctcagcagcagcagcagcagcagcagcggcagcagcggccgtgcacgcccgggctgcggtcgcacagcgctaacgtgagcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcgttcgttcacatagctcccagttttaacatttcgccacctactgaagacatcatttgggaccaagctgatgagcccttgaagcacagcagataagagtgttgctgttgatcatctttgcctgggaagttgaatgataaagccagaagaaagcatgctttctgatcatttgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtaccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaatatatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtgttgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctatcaccgggaaccctccctgtccccttcccgaatcacacacataccctaccctcacctgatgataattttctcttcttgctgcaaaactggttggcttgcaacccagagagagcagcttcccttggctctggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaaaaaaggcttttctttttaaacagttccacttttaaaacctgcctctgggtttttgttttttcttgtttgtgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactggtgacagtgagaatataaactcaatgtgaatcacgtgatacttcgcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatgagttagtgtttcttccccaaactgaagactgtgttggaagtgcaatttctggtgagtcagtccacaatacaatgccctgtgtggagttggtattcatacaggaaatctgtgtgcacgaggcattgtgtgttgaaagtgtatgtttatagtactgcctgagccatctcatgaccccagcgtccaaaaccgatgctgtagaacagaacatatctgtacacaaatagtgtgtgcaaatagcatttgtacatagaaaagtctcattgtggcagattgagcataaattattcaactgacggtgcaaaaacattacttgcaaagaaaagtttatagtattttcctacactccaccctgggagatgatatttctatcaaatgaatatcagtgcattttaaatgtaatatgaaaacgatgctgccattttgtgaagaatacccacttggttgcagaggccaactttcatagctttgatttaatgttgtgacacggtgtatgcattttgctgtcaagcaatggataaacagctctgactttcattctcattccagtttattgacctcagataaaacactggcccttcttagaagcagaagtgtgcaccaagaccattcatttcaggtagactcacattcagtgccaagtgctcccatgggaataatcagacgcatatgttgcgaaagagtgaagggacttggacaaagaggggttttcctacagatggatgctcagtcttctaccaaaacatgtttggaggcagaactatgacctccccttaagtcctaacaatgtattttgtgtgtgcaaatcctgggatgcccgtttcacgctctgacataaagacatggcacctctagtgagtgatcaggaagattccatatgcatttgggagcttcaggtgcttgttagacacagtgagccattcaaggcaagcaccacctttgctagtgaggccaagagagcctgtgacaatttgacaatttgttccagaaccagtctgatgcaagtgcacctctaatatatgccttacaaactccagaggccatattcaaaacagggtcttctcagtgtatgcaaggggctgcagcccctcttctcttcctccccaggttgaacaatacggacagttttcacacatatctacctgtataaccctctgtacctctcataactggtcaacgactgtaacaggttacatcaggtgtttttctacatactttttacacagattctatgcgattaatgtaatttaattcaatgcatcattttattgtactagttcttaggcttgtccttatttttttctaagtgattgtggtttttctcgtggtttttattgtaaaaaatgaaaggctgttgatgcttattctctgtaactaagaatttttaccttttgggggaaaaaagcattgctatgaactaatgaattgaaacttcatttactcattgtaaatacactattgtgcaaaaaaagttttcactcaattgaattgctagtgttaactgaattttgtctagacaccatttctgttgatgaaataaagacatatcattatgcattgtaaactga

SEQ ID NO: 60 - DNA, 1891 bp, Homo sapiens
gtctctggtatctcccgctgagctgctctgttcccggcttagaggaccaggagaagggggagttggaggctggagcctgtaacaccgtggctcgtctcgctctggatggtggtggcaacagagatggcagcgcagctggagtgttaggagggcggcctgagcggtaggagtggggctggagcagtaagatggcggccggagcagtaagatggcggctggagtggtttttctggcattgtctgcccagctgctccaagccaggctgatgaaggaggagtcccctgtggtgagctggaggttggagcctgaagatggcacagctctcgatgtgcattttgtaagcactttggagccactatcaaatgctgtgaagagaaatgtacccagatgtatcattatccttgtgctgcaggagccgacacctttcaggatttcagtcacatcttcctgctttgtccagaacacattgaccaagctcctgaaagatcgaaggaagatgcaaactgtgcagtgtgcgacagcccgggagacctcttagatcagttcttttgtactacttgtggtcagcactatcatggaatgtgcctggatacagcggttactccattaaaacgtgcaggttggcaatgtcctgagtgcaaagtgtgccagaactgcaaacaatcgggagaagatagcaagatgctagtgtgtgatacgtgtgacaaagggtatcatactttttgtcttcaacgaattatgaaatctgtaccaaccaacggctggaaatgcaaatgaataccgaattggaaaaacagatttctaatgaggctgatagtgaagaaatgaaaatgtcttctgaagtgaagcatatttgtggcgaagatcaaattgaagataaaatggaagtgacagaaaacattgaagtcgttacacaccagatcactgtgcagcaagagcaactgcagttgttagaggaacctaaaacagtggtatccaaagaagaatcaaggcctccaaaatttgtcattgaatctgtcactcttccactagaaaccttagtgtccccacatgaggaaagcacttcattatgtcctgaggaacagttggttatagaaaggctacaaggagaaaaggaacagaaagaagattctgaactttctactggattgatggactctgaaatgactcctacaattgagggttgtgtgaaagatgtttcataccaaggaggcaaatctataaagttatcatctgagacagagtcatcattttcattatcagcagacataagcaaggcagatgtgtcttcctccccaacaccttcttcagacttgccttcgcatgacatgctgcgtaattacccttcagctcttagttcctctgctggaaacatcatgccaacaacttacatctcagtcactccaaaaaactggcatgggtaaaccagctattactaagagaaaattttctcctggtagacctcggtccaaacaggaggcttggagtacccataatacagtgagcccaccctcgtggtccccagacatttcaggaggtcgggaaatttttaaacccaggcagcttcctggcagtgccatttggagcatcaaagtgggccatgggtctggatttccaagaaagcggagacctcgaggtgcaggactgtcggggcgaggtggccgaggcaggtcaaagctgaaaagtggaatcggagctgttgtattgcctggggtgtctactgcagatatttcatcaaataaggatgatgaagaaaactctatgcacactacggttgtgttgttttctagcagtgacaagttcactttgaatcaggatatgtgtgtagtttgtggcagttttggccaaggagcagaaggaagactacttgcctgttctcagtgtggtcagt

SEQ ID NO: 61 - DNA, 2230 bp, Homo sapiens
gcagagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccacaaaaaaaaaaaa

SEQ ID NO: 62 - DNA, 2241 bp, Homo sapiens
ggcgctctctgtcccgctcggagctgctcggcgccccagctgcccgccccgccggccgctcctgcccgcggcgcagatggctgtgcgcggcgccaacaccttgacgtccttctccatccaggcgatcctcaacaagaaagaggagcgcggcgggctggccgcgccagaggggcgcccggcgcccgggggcacagcggcatcggtggccgcggctcccgctgtctgctgttggcggctctttggggagagggacgcgggcgcgttggggggcgccgaggactctctgctggcgtctcctgccggtaccagaacagctgcggggcggactgcggagagcccggaaggctgggactcggactccgcgctcagcgaggagaacgagagcaggcggcgctgcgcggacgcgcggggggccagcggggccggccttgcggggggatccttgagcctcggccagccggtctgtgagctggccgcttccaaagacctagaggaggaagccgcgggccggagcgacagcgagatgtccgccagcgtctcaggcgaccgcagcccaaggaccgaggacgacggtgttggccccagaggtgcacacgtgtccgcgctgtgcagcggggccggcggcgggggcggcagcgggccggcaggcgtcgcggaggaggaggaggagccggcggcgcccaagccacgcaagaagcgctcgcgggccgctttctcccacgcgcaggtcttcgagctggagcgccgctttaaccaccagcgctacctgtccgggcccgagcgcgcagacctggccgcgtcgctgaagctcaccgagacgcaggtgaaaatctggttccagaaccgtcgctacaagacaaagcgccggcagatggcagccgacctgctggcctcggcgcccgccgccaagaaggtggccgtaaaggtgctggtgcgcgacgaccagagacaatacctgcccggcgaagtgctgcggccaccctcgcttctgccactgcagccctcctactattacccgtactactgcctcccaggctgggcgctctccacctgcgcagctgccgcaggcacccagtgaacccgcttgggctgaggcagcgagtgattcccgcgctccggctccggaccggcgctgacagctgtaggctgtagcctgcacggggcgccccgccaaggaggcacctggaggtgaaacccagctccagctcccgttagccaggacttgtcccctggcagctgggctgagtctgccctgagggggcgcctttttctaatttgaacagaggcaccctatggcctaggggccctgatcgcccacctgcctggaagcccctgggctctatttattatcatgacaatgttggaattaaattttgattcgaatatgtctgcctgggggtggggttttccctgagcggcaactcctggagaccacatagcctgaatcctcagaatttcaggcctgctgggagctttctgcactaggccacactagttcatggtatccatgctaccaatctatgtgtatctacatatcttttatttttggaaattgcatttgtaaccaaggggtgcgaaaccctggcagtcccaggcagcaccaggccaggggttgatttgaaacgtgaaggattgggttttcaggccctctgctccacccctcctgtgtgtcagagctagggtgggggtgcccgattcgggtgctgaatgtaaggaggggagcctccaagtgtggtgcaagccgggggtctccacatcttccttctctgaagtccaggtacctgcacaagcaggaagcgcctgggagtcccggaaggaggagagcgcacacccaggcagccctctgcggaaactttccttggtttctttttatttgtgtaaaggaggttaagacgtgtcgcacttttcagttgtttgtattcaaatgacgattatttttctactcaatgtgaatatccctggccagcctttccacggcgcccaccgcagtgccgctgcctggccctcagtgtctaccttctgccctctgcgactccagtgctctggcccgggactcccctatccgcccctcacttacccttaaacaggtgatcccacctgtcttgtcaacctcgccgcttttcgcctccttaatggcactgtgcactcaactagagtattaactgtaaaaagatttgtgaagtttggaagctctattcgctgtattttttctttaatttataaacttttagtttaacatgc

SEQ ID NO: 63 - DNA, 1907 bp, Homo sapiens
cttttggatctaatgcgcagaggaggttggcccagagctcccgggctcccccaaggctgaactccgtccaaggtgcccgcaggctccctgcccgccttccccatgccagcccgcagctaggggcaggggcagcggcggctggggttgggggtgggtggggagcttttggggaggacaggtcgcagcttggctatggaaggctccaatggctttgggatcgactccattctctcccaccgcgcgggcagccccgcccttcccaagggggaccccttgctcggggactgccgttcgcccctggagctgagtccacgctcagagagcagcagcgactgctcttcgccagcctctccaggaagggactgtttggagacggggaccccacggcctggcggggcatccggcccaggtttggactcccacctgcagcccgggcagctctcagccccggcccagtcgcgcaccgtcacctcctcctttctgatcagggacatccttgccgactgcaaaccactcgcggcctgtgcaccctactctagcagcgggcagccggcagcccctgagcctgggggccgccttgcggccaaggccgcggaggactttagagacaagctggacaaaagtggcagcaacgcctcatcggactctgagtataaagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacctggtaccagaaccgcaggactaaatggaagcgacagacggccgtcgggttggagctgctggcggaggcaggcaattactcagcgctccagcggatgttcccgtcgccttatttctacccgcagagtctggtttccaacctggaccccggcgcggcgctctacctgtaccgcggccccagcgcgccgccgcctgctctccagagacctctggtgccccgcatcctcatccacggactccagggcgccagcgagccgcccccgccgctgccccccctggccggcgtcctcccacgcgccgcgcagcctcggtgaggcgcccgtcggctccggggcctcctcccgcgggctcggcgtggccccttccgcccgcctttctgagggcgcaggttcgacgccctttcccgggagggggccctgcccggccctccctggcgccccagcccagtgccccccgaagggccaaatgccaagtccactgaggcccggaccccggactgcgtctccccagcccccctcggcgtcctctctcgcggccgctctgtccgggagccatccccacccgccgggtgtacatacgcgtctctgccactccccacccccagcctctgccggctcccctaggcaacccctttctccccaggagcgggtgcggctgattcccaggcttcgctctctcccacgccccttctacgctccaggtggagaacagcccctctccccgcgcccccgccagggagagaaggggagtgcggagccccgtctccctacccctcgagcacctgggccagcggctgagctgtacataccgtgtgcaaagtgtatatgaagttatttattcgtgacccatgagcccgtgaccgtgtccgtggattagtgagtctgtggcctgtgccctccccactcccaggcggggcaggaaggggccaagggggcttgcccacccaccccgaccccagcccccagcctcagccccggtccgggggcagccaggcctctcgggttctctcttttttaaatgtcgaaataaacttcttacaaatgac

SEQ ID NO: 64 - DNA, 208 bp, Homo sapiens
agttgctggccgaggcagggaactactcggcgctgcagaggatgtttccatcgccttatttctatcacccaagcctgctgggcagcatggacagcactacggcggcggcggctgccgctgccatgtacagcagcatgtaccggactcctccagcaccccatccccagctgcagcggcccctggtgccccgtgtgctcatccacggcct

SEQ ID NO: 65 - DNA, 1498 bp, Homo sapiens
gcgcgccccgcccgcgccctgcgcctccgcccggccggccggcgggggagggggcatgagccggcgcccgcgcgccgccccgagctgcgggccggcctagagccccgcgcgggccccgcgccggagccaagccgtcgccgccgccgccgccaaaccgcgggcgcagcagtgggcgccgcgatgcagcggccgggggagccgggcgccgcgcgcttcggcccgcccgagggctgcgcggaccaccggccgcaccgctatcgcagcttcatgattgaggagatcctcacggagccacccgggcccaagggcgccgcgcccgcagccgccgctgccgcggcgggcgagctgctgaagttcggcgtgcaggcgctgctggcggcgcggcccttccacagccacctggccgtgctgaaggccgagcaggcggcggtgttcaagttcccactggcgccgctgggctgttcagggctgagctctgcgttgctggcggcagggcccgggctgcccggcgccgcgggtgcgccacacctgccgctcgagttgcagctccgcgggaagctggaggcggcaggccctggggagccaggcaccaaagccaagaaggggcgtcggagccgcactgtgttcaccgagctgcagctgatgggcctggagaaacgcttcgagaagcagaagtacctttccacgccggacagaatagatcttgctgagtccctgggcctgagccagttgcaggtgaagacgtggtaccagaatcggaggatgaagtggaagaaaatagtgctgcagggcggcggcctggagtctcccaccaagcccaaggggcggcccaagaagaactcaattccaacgagcgagcagcttactgagcaggagcgcgccaaggatgcagagaaaccggcggaggtgccgggcgagcccagcgacaggagccgcgaggactgagggcggtatacggtgcggggcctgggatgcccgcgccacccgcagccccctcactcggcggaaacccgcgagccggcccttccgcgtccaagaagtttacttcctaagcctttttattatgatcttgaatgcggacaattggggccaaacgaggaaggacacagacccaaaagccagacccaggtcccagcgcgcttctgggctctaacctgggagactcgcatccagcccggcggaagctacagtctctaccctgagctccgtggcgcagagcgctccacgcgtattcacgccccgctcctcgcctgcacccccaccccgtctggggcctgccctcccggccggggagcctccaggcacacacccgcttctggacgtcggggacccagcggttgggctcaggccacaacggcctgagattgccccggggcaacccgtcggctcggcctggaggccgggtccccgatgtcgctggggcccctaccccctcttgcgaagacggtgactttttttccaataaaatattttatgacacaaaaaaaaaaaaaaaaaa

SEQ ID NO: 66 - DNA, 1767 bp, Homo sapiens
cgggcactcgcagccgcgctcgggccggcggacgctcgcgccggctcaccatgcactgccacgccgagctgaggctgagctcgcccggccagctcaaagcagccaggcggcgctacaagactttcatgatcgacgagatcctctccaaggagacctgcgattactttgagaaactttccctctactccgtgtgcccgtcgctggtcgtgcgacccaagcccctgcattcctgtacgggctccccttccctgcgggcatatccgctcctctcggtgatcacccgccagcccactgtcatctcccacctggtccctgccaccccgggaatcgcccaggcactgtcctgccaccaggtcaccgaggcggtctctgctgaggccccagggggcgaggccctagccagcagcgagtcagagacggaacagcccacgccccgacagaagaagccccgccggagtcgcaccatcttcaccgagctgcagctcatgggcctggagaagaaattccagaagcagaagtatttgtcaaccccagacaggttggacttggctcagtctctgggactcactcagctgcaggtgaagacctggtatcagaatcgcaggatgaaatggaagaaaatggttcttaaaggtggacaggaagcacccacaaaacccaaaggtcgccccaagaagaactccatccccacatcagaagagattgaagctgaagagaagatgaacagccaggcccagggtcaggagcagctggagccctctcaggggcaggaggagctctgtgaagcacaggaaccgaaagcacgtgatgtccccttagagatggcagagccaccagacccgccccaggagttgccaataccctcttcggaacccccaccattaagctaaagtaaaacccttttgagggaagagggagactggggagaagggaaaagagagaaggcagggagagtagggagagaaaaccttccagcagcccagtaaactgcgggcgaagagatctacccgtctccctccctcccacagttaccattggccttgtcatcgcaagcatttgacaaagacttgcttgtcttgggcctgtcacctcctgaaaggctgctttagctgtggatgcccttgattaagggagagagcgcctaggagctgcctgccccagctggggtgacggctgtagggctgggtctatgttgcaagccctatatcctagcatgcagtggaaagtgcttagctctctccctcctgacctctgggcagccagtcatcaaagcagagagacgtggcggcatgtgggcagcatgcccaggttccttgctgactcagcacttatttctgtagttttaaaaaagaatttaatgtttttggttgtatttttttgggggggtgagggtgggcaaaaacatgggggtagttctgagttgttagaaatgtttctgaatcaagtttgtttgaagacacgtgtgcctttgtacccattataagatggtcataagacccaagaactgataagctttggttttttttttgttttgttttgttttttgcttcatttacccattcatgcctagggttccattattggaaccctaagcttgtgggagttatttctatcctactgctcaaggtcatcaccaagatctgatttttcataaaaaacatttgtgaccttcggcataaatgggttaaggtgccatccctgaaactgcaatgcagatatgttcagataacttttattttttaattaaaaataaatctttcaaaagga

SEQ ID NO: 67 - DNA, 953 bp, Homo sapiens
caagagagagagagagcgtgcaagccccaaagcgagcgacatgtccctttggggagcagtccctctgcaccccagagtgaggaggacgcaggggtcagaggtggctacagggcaggcagaggaggcacctgtagggggtggtgggctggtggcccaggagaagtcaggaagggagcccagctggtgacaagagagcccagaggtgcctggggctgagtgtgagagcccggaagatttcagccatgcctcacagctccgacagcagtgactccagcttcagccgctctcctccccctggcaaacaggactcatctgatgatgtgagaagagttcagaggagggagaaaaatcgtattgccgcccagaagagccgacagaggcagacacagaaggccgacaccctgcacctggagagcgaagacctggagaaacagaacgcggctctacgcaaggagatcaagcagctcacagaggaactgaagtacttcacgtcggtgctgaacagccacgagcccctgtgctcggtgctggccgccagcacgccctcgccccccgaggtggtgtacagcgcccacgcattccaccaacctcatgtcagctccccgcgcttccagccctgagcttccgatgcggggagagcagagcctcgggaggggcacacagactgtggcagagctgcgcccatcccgcagaggcccctgtccacctggagacccggagacagaggcctggacaaggagtgaacacgggaactgtcacgactggaagggcgtgaggcctcccagcagtgccgcagcgtttcgaggggcgtgtgctggaccccaccactgtgggttgcaggcccaatgcagaagagtattaagaaagatgctcaagtcccatggcacagagcaaggcgggcagggaacggttatttttctaaataaatgctttaaaagaaaaaaaaaaaaaaa

SEQ ID NO: 68 - DNA, 6031 bp, Homo sapiens
cttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttcaaataaaaaaaaaaaaaaaaa

SEQ ID NO: 69 - DNA, 6079 bp, Homo sapiens
cgttggccgggcccgggggaggaggggaatctcccgccatttttcaataatttcctccggtgctgctgaggagagtcgtgactgccggccgccgggacccgaagcggaggtcggcggggggctgctgggaggcgcggcggtgtgcgcgggagctctgcgccggtggcgttccgctccatgactgtcgcgcggccgcgccggcggtgagggagccggagttcgcgccgccctctcacccctcccttcacccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacatgatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattgagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaaccaa

SEQ ID NO: 70 - DNA, 8934 bp, Homo sapiens
agtctgtcacacagggacatcaccctacagcagttcaggctgtgtggttcgcaggaagcatacactggctttttgattcttgctagttcccagctcacagtttgggaggatccaacaccaacctttacgtgaagtggaggcccaaggacagtgaggagctgggtggtcccagcctggagctgtgccagcctgacatggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgcgtgcttgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaaccacatttgatagagattcaaaagactctgtgtattcatcttcccttctacacacctgagggggagacggcgttgggataggtatgactggcttaagagaccacaggcaagggaacaacaggggctcctgttccataccctctgtgtggatggaaagggtcattagtgctcctgcctaaatgtctggctgagttgctggagcaaagggggattcagtgcatccaggtcctgccttgtgagatgtggccccagcttcctaagctgccacctctgtgttcctgtcatagcaaatatgggaccatcaccagcttaccacttcccactcacggataagacaccaagacgtagac

SEQ ID NO: 71 - DNA, 8145 bp, Homo sapiens
acttggttcatgaagccttcgcctagaagtgaagctgctgaacaaaccttgagaagaatcatctcctgcttcaatctgctgctggataggaactaatcagagagagagaggcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccaggtgcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 72 - DNA, 3958 bp, Homo sapiens
ttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 73 - DNA, 7603 bp, Homo sapiens
ttttcttgcttttcttcccttttttttctttttgcaaacaaaacaaaaaacagcatagaagaaagagcaaaataaagaagaagaagaggaggaagagagggaaagagaggaagggaaaaaaaacaccaacccgggcagaggaggaggtgcggcggcggcggcggcggcggcagcggcggcagcggcgcggcggcggctcggaccccctcccccggctccccccatcagtgcagctctccgggcgatgccagaatagatgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaaaaaaaattctggttgaagatagaggatatgaaatgccataagacccaatcaaatgaagaaataaacccagcacaaccttggacatccattagctgaattatcctcagccccttttgtttttgggacaacgctgcttagatatggagtggaggtgatttactgctgaattaaaactcaagtgacacaagttacaagttgatatcgttgaatgaaaagcaaaacaaaaacaattcaggaacaacggctaattttttctaaagttaaatttagtgcactctgtcttaaaaatacgtttacagtattgggtacatacaagggtaaaaaaaaaattgtgtgtatgtgtgttggagcgatctttttttttcaaagtttgcttaataggttatacaaaaatgccacagtggccgcgtgtatattgttttcttttggtgacggggttttagtatatattatatatattaaaatttcttgattactgtaaaagtggaccagtatttgtaataatcgagaatgcctgggcattttacaaaacaagaaaaaaaatacccttttcttttccttgaaaatgttgcagtaaaatttaaatggtgggtctataaatttgttcttgttacagtaactgtaaagtcggagttttagtaaatttttttctgccttgggtgttgaatttttatttcaaaaaaaatgtatagaaacttgtatttggggattcaaaggggattgctacaccatgtagaaaaagtatgtagaaaaaaagtgcttaatattgttattgctttgcagaaaaaaaaaaaatcacatttctgacctgtacttatttttctcttcccgcctccctctggaatggatatattggttggttcatatgatgtaggcacttgctgtatttttactggagctcgtaattttttaactgtaagcttgtccttttaaagggatttaatgtacctttttgttagtgaatttggaaataaaaagaaaaaaaaaacaaaaacaaacaggctgccataatatatttttttaatttggcaggataaaatattgcaaaaaaaacacatttgtatgttaagtcctattgtacaggagaaaaagggttgtttgacaacctttgagaaaaagaaacaaaaggaagtagttaaatgctttggttcacaaatcatttagttgtatatattttttgtcggaattggcctacacagagaaccgttcgtgttgggcttctctctgaacgccccgaaccttgcatcaaggctccttggtgtggccacagcagaccagatgggaaattatttgtgttgagtggaaaaaaatcagtttttgtaaagatgtcagtaacattccacatcgtcctccctttctctaagaggccatctctaagatgtcagatgtagaggagagagagcgagagaacatcttccttctctaccatcactcctgtggcggtcaccaccaccacctctcccgcccttaccagcagaaagcaatgcaaactgagctgctttagtccttgagaaattgtgaaacaaacacaaatatcataaaaggagctggtgattcagctgggtccaggtgaagtgacctgctgttgagaccggtacaaattggatttcaggaaggagactccatcacagccaggacctttcgtgccatggagagtgttggcctcttgtctttcttccctgctttgctgctttgctctctgaaacctacattccgtcagtttccgaatgcgagggcctgggatgaatttggtgcctttccatatctcgttctctctccttcccctgcgtttcctctccatccttcatcctccattggtcctttttttttctttcattttttatttaatttcttttcttcctgtctgttcctcccctaatcctctattttatttttattttttgtaaagccaagtagctttaagataaagtggtggtcttttggatgagggaataatgcatttttaaataaaataccaatatcaggaagccattttttatttcaggaaatgtaagaaaccattatttcaggttatgaaagtataaccaagcatccttttgggcaattccttaccaaatgcagaagcttttctgttcgatgcactctttcctccttgccacttacctttgcaaagttaaaaaaaaggggggagggaatgggagagaaagctgagatttcagtttcctactgcagtttcctacctgcagatccaggggctgctgttgcctttggatgccccactgaggtcctagagtgcctccagggtggtcttcctgtagtcataacagctagccagtgctcaccagcttaccagattgccaggactaagccatcccaaagcacaagcattgtgtgtctctgtgactgcagagaagagagaattttgcttctgttttgtgtttaaaaaaccaacacggaagcagatgatcccgagagagaggcctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttggaactatttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctccaaa

SEQ ID NO: 74 - DNA, 3796 bp, Homo sapiens
ctggtctggccggcgacgcgcgtgccctgtggccaaacactgcctggagtgagagcaaactaccagcgcagtggggccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacaactctgggacatctggagaaagctgtagtcttggaattaactttgaaacacttaaaagctttaaccgccttaaccgagcaacagcatcagaagataattgctttacagaatggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccggcgcccaagaggatgaagctggattcccgcggcggcggcagcggcggcggcccggggggcggcgcggcggcggcggcagccgcgcttctggggcccgaccctgccgccgcggccgcgctgctgagacccgacgccgccctgctcagctcgctggtggcgttcggcggaggcggaggcgcgcccttcccgcagcccgcggccgccgcggcccccttctgcctgcccttctgcttcctctcgccttctgcagctgccgcctacgtgcagcccttcctggacaagagcggcctggagaagtatctgtacccggcggcggctgccgccccgttcccgctgctataccccggcatccccgccccggcggcagccgcggcagccgccgccgccgctgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatacgatatgatattgtctaataattaaaaaagacataatggatgctcaattagttttaagatatctataactatagggatacaaatcactacagttctcagatttacagcttttttttgtcattggcttgatgtcacacatttccaatctcttgcaagcctccaggctctggctttgtctacctgctcgttcccaatgtatcttaatgaaaagtgcaaaagaaaaacctaccaattaaaaaaaaaaaaaaaaaa

SEQ ID NO: 75 - DNA, 3388 bp, Homo sapiens
gtttgttaccgttttaatcctattaattaaaacgttaacctgattgggtagaaagcgctgtcccaacaggcgagtcttcttcataataacctactcagagataatgatgtaaaagactcccccgtctgtggcggcggctgtttgatgggtccggaaatctcttgaaggtgaatccaagcaagataaacggtgcggagaggaggcgcggggctgggctcagagcggcggcggcggcggctccactccctccgcgcccaccctcccaccatgcggggccgcggcccatggtgagccccagcagccagcaccatcggctggagacgaagaagaagaagaagaggaggcggcgagcgcgggggaaggcgaaaaagaaaaagaaagaaggggagagggctcccggcagcaccaggaccgacgcgcgcaccagctccggagcccagctcgcgcgcgtctgtggggccgcctgactccggggccgaggcggcggcggcggcagcgggcgcggcggcccgggctgcgcgccggcgcgggaccatggagcgcgggatgcacctcggtgcagcggccgccggcgaggacgacctcttcctgcacaagagcctgagcgcctccacctccaagcgcttggaagcggctttccgctccacgcccccgggcatggacctgtccctggcgccgccgcctcgggaacgcccggcgtcctcctcctcgtcgcccctgggctgcttcgagccggctgaccccgagggggcagggctgctgttgccgccgcctggaggaggcggcggcggcagcgcgggaagtggcggcggcggcggcggcggggtgggtgtccccgggctgctagtaggttcagccggcgttgggggcgaccctagcctaagcagcctgccggccggggccgccctttgcctcaagtacggcgaaagcgcgagccggggctcggtggccgagagcagcggcggcgagcagagccccgacgacgacagcgacggtcgctgcgagctcgtgctgcgggccggagtagccgacccgcgggcctccccgggagcgggaggtggtggcgcgaaggcagccgagggctgctccaatgcccacctccacggcggcgccagcgtccccccggggggcctgggcggcggcggcggcgggggtagcagcagcggtagcagtggcggcggtggcggtagcggtagcggcagcggcggcagcagcagcagcagcagcagcagcagcaagaaatccaaagagcaaaaggcgctgcggcttaacatcaatgcccgagagcgccggcggatgcacgacctgaacgacgcgctggacgagctgcgcgcggtgatcccctacgcgcacagcccctcggtgcgaaagctctccaagatcgccacgctgctgctcgccaagaactacatcctcatgcaggcgcaggccctggaggagatgcggcgcctagtcgcctacctcaaccagggccaggccatctcggctgcctccctgcccagctcggcggctgcagcggcagcagctgctgccctgcacccggcgctcggcgcctacgagcaggcagccggctacccgttcagcgccggactgcccccggctgcctcctgcccggagaagtgcgccctgtttaacagcgtctcctccagcctctgcaaacagtgcacggagaagccttaaacacacccccgaaaaacacaagaccgacccaaaatctagaggaaagcgaaaagctgctccccaccccctttattttggtcctctcgtagttgtgaaacacttgcagagcaaacaaagcagaggcaagaactgaggagaagtatcagagacaaacgggacttttagccttgacatccccagaatctcggtctttggggtggggagggagggaggagggaggtggagttgggatggagtatggatgtcttttttttctcagaaaagtggcaactttggtggcagcctagaccgcgaggaagtggaatcttccttaaaggtgaaacataagttgagaagtagtgcttggttattaagcctggagagtgtttgaatggcaaaatactaatcctactaataattgtggatttggctagtgctgagggggagaggaggggttaggggttgggtagcatgagagatggaatattcattcagacaaatcagaaagggcacttgaaaataaattttgattctgagccaggagaaaaacttgaaatgttgacttaagtgagggggaaataaaacccagagagagagagagagcgagagagagagacatgttactatgaaagacttgtattttttattgtctctgaactttaatcctgtgaaaatgctcaaagttttggcgagagtgatataaaaaaactgactgtggctgaaagaattgcatttaaaaatatttatgtgcaccttgttactttctactctgcaatgatgtattaacaattcatggtatttatttgttattcttcaatgacccttccacatcaacagtatttatcatgtgttaaagtcatgggtcttatgtgcagatttttttaatgcctctaaaattgttttatagattacttatgctgtgtgccaagtgtttaaaggtttatttgccaacaagtatgaagagaaatattgatgtatctgagctgcttaggtttatgaaaggtcacctggatattttcagttgcatcatccctgtatttaaattgagctttaataaattgcttcagtccaaaaattacaggaaaggtgtattcttaattgatgaatgaattgatctcttttttgaaaggggactcctttacattccaaaagggaaaaacatcacagcaatagttgctatacgtaagaacatgctaagcaaatatttttccaggctgtgctgtgcatttttaaaaggtctaatttaattgcttttaatatatatgtacatatatgttattttaactgtggagaattatttaagttaaaagactggtttgatttgcctatggtgtgaaatcctttgttatttttctaaaaaaataaaatttaaaaagaaagaaaactaaggaagaacaagaagctatttacccaaagtgagctttcagttttagttttgcatggctgtttgactgcctttccgccctatgaaaatcaagaaaatcttttttaaaaatggagtcctgctattttccactccttgcagataatacaaattcagtttgtcaggttggatggtgagttgggagctgtgatggatctgttggcgggttttggatgtgtaaagaatgatatatatattaaataggtcaatcagactatgacagctatgtacgaccatttgtatgtgtatctatgtcagaaagaatctttattaaaatattttgatcaaacaaaaaaaaaaaaaaaa

SEQ ID NO: 76 - DNA, 5158 bp, Homo sapiens
gggagacggtgcgggcggccgggagcgcagccctccgggaggcgggtcatggcctgggcgccgcccggggagcggctgcgcgaggatgcgcggtgcccggtgtgcctggatttcctgcaggagccggtcagcgtggactgcggccacagcttctgcctcaggtgcatctccgagttctgcgagaagtcggacggcgcgcagggcggcgtctacgcctgtccgcagtgccggggccccttccggccctcgggctttcgccccaaccggcagctggcgggcctggtggagagcgtgcggcggctggggttgggcgcggggcccggggcgcggcgatgcgcgcggcacggcgaggacctgagccgcttctgcgaggaggacgaggcggcgctgtgctgggtgtgcgacgccggccccgagcacaggacgcaccgcacggcgccgctgcaggaggccgccggcagctaccaggtaaagctccagatggctctggaacttatgaggaaagagttggaggacgccttgactcaggaggccaacgtggggaaaaagactgtcatttggaaggagaaagtggaaatgcagaggcagcgcttcagattggagtttgagaagcatcgtggctttctggcccaggaggagcaacggcagctgaggcggctggaggcggaggagcgagcgacgctgcagagactgcgggagagcaagagccggctggtccagcagagcaaggccctgaaggagctggcggatgagctgcaggagaggtgccagcgcccggccctgggtctgctggagggtgtgagaggagtcctgagcagaagtaaggctgtcacaaggctggaagcagagaacatccccatggaactgaagacagcatgctgcatccctgggaggagggagctcttaaggaagttccaagtggatgtaaagctggatcccgccacggcgcacccgagtctgctcttgaccgccgacctgcgcagtgtgcaggatggagaaccatggagggatgtccccaacaaccctgagcgatttgacacatggccctgcatcctgggtttgcagagcttctcatcagggaggcattactgggaggttctggtgggagaaggagcagagtggggtttaggggtctgtcaagacacactgccaagaaagggggaaaccacgccatctcctgagaatggggtctgggccctgtggctgctgaaagggaatgagtacatggtccttgcctccccatcagtgcctcttctccaactggaaagtcctcgctgcattgggattttcttggactatgaagccggtgaaatttcattctacaatgtcacagatggatcttatatctacacattcaaccaactcttctctggtcttcttcggccttactttttcatctgtgatgcaactcctcttatcttgccacccacaacaatagcagggtcaggaaattgggcatccagggatcatttagatcctgcttctgatgtaagagatgatcatctctaaaattctgttcccaagatgcagtcctagcgtagcgaacgttcctggagtggggtgaaggatatcaatatactaagttttaacagataccccatttaggtcagcacttgattcgttgttgctgtgaaatatgtccatgggacaaaagagggaatatgaaatatttgcatatgggaagattatagagcataataattttgtaaatggagcaatctcaacctctatttctagatcacattttcttgatgtcttccttcaaattaatgaccttggattacataaggatttctatgcattcattataatttgttattcctttcaatatccttgtatttcaaatcttccatataagaattagacatggcaattcttaaattgattcagaatggtctgatactattccagtatcacctccttaattctgtttctcctcgttttcctgattttccttctcattctctccttccccgctctgtctctctctccctgtcactctctctctcttgttccttattttttgtttcttacctcttactgtttaacctgttgcttccttctggattaatacatttagagccattcctttatatggtcacatttcctatgactttactcaattacttttaaaatcctttctattctgagactaatttttaagaattacaaagctcattcttctgaatctaatatcactaactcctagactttttccgttttctttggatacactttaagtaggaatttatcagaattttcattcaactcgttctttaatgcagatatttactagttataagaccttaaggctgggtgcagtggctcacgcctgtaatcccagcactttgggaggctgaggcgggtggatcacaagctcaggagttcaagaccagcctggccaacatggtgaaaccctgtctctactaaaaaaaaaaaaaaaatagaaaaattagctgggcatggtggcaggagcctgtaatcccagctattctggaggtggagacaggagaattgcttgaaccctggaggcggaggttgcagtgagccaatatctcaccactgtactccagcccagtgcgagactccatctcaaaaaagaaaaaagacctcaaacaacacttctctctctcttttagctgcttgttatggttcctatacatggaacaattatactggcctcactgtgttatggtaaatatttaaggtcatatttgatattgctggtttgaattcagcttttccatttaaatacattataatgatgatgatgaaatcatgataatatttaacttatttttaaagtatattctgtacctttccaacaaaaaggttaaaagtcattgaaggctaaccttactgccttctttgtatcactgtcttctaaataattattatgtctgggtacagtggctcacgcctgtaatcccagcactttgggaggccgaggtgggcagatcacgaggtcaggagattgagaccatcctggctaacacagtgaaaccccgtctctactaaaaatacaaaaagaaattagctgggcgtggtggtgggtgcctgttgtcccagctacttgggaggctgaggcaggagaatggcatgaacccaggaggcagagcttgtagtgagccgagatcgcgccactgcactccagccggggcaacagagcaagactccatctcaaaaataaataaataaataaataaataaataaataaataaataaatattacacaaatgctaaaatgtttaaatggtaaatgcttcaatgctaaccaaatattaattaatggcaaattatttaacattatctgataataatctgcagaaggtttaattttcctcctcaatttgaagttcaagatgtttttctcttccagggagattttttcgactgacatctttaacttaccttccaatcatattactaacgtagccttcttcctagattttttaattgtttgatcatgagcgaacacttctactctctgtgatagatttgcaaacagaggaaataacgcatcctcgtgtccctcttcttggtgttccacaggccatgtgtgccctagccctcgttcatgcaaggtctgtgtagggaaggtggacttcagctcagcaacagcatcccttcccacagggatcaggtgggtggcttgagataccccttccatggggcaccacccattcagtgagacggggaagccctgggtgggagggagaacacctccacatgtcttctactctctccataggatggaatgagtgtcccagtcccaggagtatccatttcccactgtgtagcccagtactctggtctcactgtctctgctgaatcctgtctcactgtgcatattattgtggtttatatcagtcagtaaaccaatgtgagtcttcatctcttgcattcttaggttcatagttttgtgtgtctcctgtaatgactcttctctttccctttccaactcctgaaagattgccactatttcctctggaactttgtttcgttaccagcaaaatcctcgacatccatacccgtttcctggctttccctctcctttcctctgaatggtagtcttttatattcagctgtccacttgacatcaaaatagacattttgaactcaatttgcctaaaacttacccacaaatttctccccaagtctctccctaactgcaacaacaaaaaccacaggcttctccctgtcactggatggcaactccattcttttgattgcttaagccaggcatccgattgagtactttcttgatttctccagcccacatccagtccatcggcaagccctgttggtcctaccttcagaatatgtccggggttcagttgtcctggccaccctgctgctgtaaccatggtcagaactccatcctgcccctctggattatgactttcgtttcctcacagtggtcctgcttgggctctaggcccttccactcccattctctctacagcagctgggctgattcctttagcacccaaggatatgttggcatcacagtgacttagataccatcacaaagacctcccattcaacttagagtgaaagtcagaatcctcacagtgaatccccaggccctagaggatgtgaacccccaggccctagaggatctgaacccccatccctcctctgattatctctcccacccccacttccctttgcattctgctccagctgccctggcctcatggctgggtttccaccaaagcaggcacttcccatcacagggccatttccccgcctgtggcttctgcttgacattcccttttccctgatatccccttgactcattattccctttcttccttaactcttctgagatccagcttctcagtgataccacacagccctactccccccagagcccatctagagctcacctttccagtcgcccttgccaggctcagtggaggctctttgttccccatacagtacgtgtcgtcgtactatattgttaggcttatttaatttatgtatgttttgcctttttgtgctaaatgtaaacaccacaaggggaggtatctttgtctgttgacaatgatacattcaatgtttctcaagcacccccaatgctggtttgtatgtggttatcattcaatctgtatttgttgaatgaataaatgattgactatgtggagagcaaaa

SEQ ID NO: 77 - DNA, 2344 bp, Homo sapiens
agttttacttccgtttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttaccctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaaatcgtgagttaaaaaagttactggtggcttctgttggggatgatcttcagtatcactttgaacgtctagcccgtgagaaaaatcagcttattttagaaaatgaagccctaggtcgaaacacagctcagctttctgaacagttagaacgtatgtcaatacagtgtgatgtatggcgaagtaaattccttgcaagcagggtaatggcagatgagttaaccaactcaagagcagctttacagcgtcaaaaccgtgatgcacacggggctatacaagatctcctaagtgaacgggaacagtttcgtcaagaaatgatagctacccagaaattattggaggagctcttagtttccttgcaatggggaagagagcaaacttactcccctagtgtacaaccccacagcacagcagagctagcattaacaaatcacaagttggcaaaagcagtaaattctcatcttctgggaaatgttggcattaacaatcaaaaaaagattccatcaacagttgaattctgcagcaccccagctgagaaaatggctgaaacggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaagaataaacaactaaataactgtattagaaaaaaaagaaacttactaaatatcataatctgatgatatgtggtcctgaattggctactagtttaagcaaataaactgtaagtcatttatgggttagttggggaataaatggatatgggctggatattcggtaatatcattaatgaaaagcagattgcagaaatacagtatgatctcagtattttgaaattgtaaatacatgtacagacaaatacttagacagtatgcatactggtgttaacagtcacaatttctgggtgatgaaaatgtaacttgaaaccgctccatttctacaatgcacatttactgtttctgttataataaaagggtatgttagaaaaacaaaaaggaggctgggcatggtggctcatgcctctaatctcagcactttgggaggccaaggtgggcggatcacttgaggtctggagtttgagaccagcctgagcaacatggtgagaccccatctctacaaaaaaaatataaaaattagccaggtgtggtggtgcacacctgtggtcccagctacttgggaggctgaggtgggaaaatcacttgaacctgggagggtgaggttgcagtgagctgagatcatgccactgcactccagcctgggtgacaggaaaaaaaaaaaaaaaaaaaaaaaaaaaaaa

SEQ ID NO: 78 - DNA, 3568 bp, Homo sapiens
gagccattttggagccggtgtcagtttccactctgccttcagcggtgcatttttttccaccctcccctccccctcctcccctccccccgctcgcacgcacacacacggcgccccccgcccgcccgcctcccccacagcaactatgaaataatcgtagtatgagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaagattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaataaaaa

SEQ ID NO: 79 - DNA, 4627 bp, Homo sapiens
gcggcgggggcggccatcgtgctgcgcagcctgggcgcttggggagccgcccacttcgccgggtcgcgccccgacggccggagcgtggatgcggcggcgcccgccgagccggggcggacgcggggcggcccgggcccgggagacgcgccggcagccccggcaccgcagcggtcgcaggatggccgaggctatcagctgtactctgaactgtagttgccaaagtttcaaacccgggaaaataaaccaccgtcagtgtgaccaatgcaagcatggatgggtggcccacgctctaagtaagctaaggatcccccccatgtatccaacaagccaggtggagattgtccagtccaatgtagtgtttgatattagcagcctcatgctctatgggacccaggccatccccgttcgcctaaaaatcctactggaccggctcttcagtgtgttgaagcaagatgaggttctccagatcctccatgccttggactggacacttcaggattatatccgtggatacgtactgcaggatgcatcaggaaaggtgttggatcactggagcatcatgaccagtgaggaagaagtggccaccttgcagcagttccttcgttttggagagaccaaatctatagttgaactcatggcaattcaagagaaagaagagcaatccatcatcataccaccttccacagcaaatgtagatatcagggctttcatcgagagctgcagtcacaggagttctagcctccccactcctgtggacaaaggaaaccccagcagtatacacccctttgagaacctcataagcaacatgactttcatgctgcctttccagttcttcaaccctctgcctcctgcactgatagggtcattgcccgaacaatatatgttggagcagggtcatgaccaaagtcaggaccccaaacaggaagtccatgggcccttccctgacagcagcttcttaacttccagttccacaccatttcaggttgaaaaagatcagtgtttaaactgtccggatgctattactaaaaaagaagacagcacccatttaagtgactccagctcatacaacattgtcactaagtttgaaaggacacagttatcccctgaggccaaagtgaagcctgagaggaatagccttggtacaaagaagggccgggtgttctgcactgcatgtgagaagaccttctatgacaaaggcaccctcaaaatccactacaatgccgtccacttgaagatcaagcataagtgcaccatcgaagggtgtaacatggtgttcagctccctaaggagccggaatcgccatagcgccaaccccaaccctcggctgcacatgccaatgaacagaaataaccgggacaaagacctcaggaacagcctgaacctggccagctctgagaactacaagtgcccaggtttcacagtgacgtccccagactgtaggcctcctcccagctaccctggttcaggagaggattccaaaggccaaccagccttcccaaacattgggcaaaatggtgtgctttttcccaacctaaagacagtccagccagtccttcctttctaccgcagtccagccacgcctgccgaggtagcaaacacgcctgggatactcccttccctcccgctgttgtcctcttcaatcccagaacagctcatttcaaacgaaatgccatttgatgcccttcccaagaagaaatccaggaagtccagtatgcctatcaaaatagagaaagaagctgtggaaatagctaatgagaaaagacacaacctcagctcagatgaagacatgcccctacaggtggtcagtgaagatgagcaggaggcctgcagtcctcagtcacacagagtatctgaggagcagcatgtacagtcaggaggcttagggaagcctttccctgaaggggagaggccctgccatcgtgaatcagtaattgagtccagtggagccatcagccaaacccctgagcaggccacacacaattcagagagggagactgagcagacaccagcattgatcatggtgccaagggaggtcgaggatggtggccatgaacactacttcacacctgggatggaaccccaagttcctttttctgactacatggaactgcagcagcgcctgctggctgggggactcttcagtgctttgtccaacaggggaatggcttttccttgtcttgaagattctaaagaactggagcacgtgggtcagcatgcattagcaaggcagatagaagaaaatcgcttccagtgtgacatctgcaagaagacctttaaaaatgcttgtagtgtgaaaattcatcacaagaatatgcatgtcaaagaaatgcacacatgcacagtggagggctgtaatgctacctttccctcccgcaggagcagagacagacacagctcaaacctaaacctccaccaaaaagcattgagccaggaagcattggagagtagtgaagatcatttccgtgcagcttaccttctgaaagatgtggctaaggaagcctatcaggatgtggcttttacacagcaagcctcccagacatctgtcatcttcaaaggaacaagtcgaatgggcagtctggtttacccaataacgcaagtccacagtgccagcctggagagctacaactctggccccttgagcgagggcaccatcctggatttgagcactacctcgagcatgaagtcagagagtagcagccattcttcctgggactctgacggggtgagtgaggaaggcactgtgcttatggaggacagtgatgggaactgtgaagggtcgagccttgtccctggggaagatgagtaccccatctgtgtcctgatggagaaggctgaccagagccttgctagcctgccttctgggttgcccataacctgtcatctctgccaaaagacatacagtaacaaagggacctttagggcccactacaaaactgtgcacctccggcagctccacaaatgcaaagtaccaggctgcaacaccatgttttcgtctgttcgcagtcgaaacagacacagccagaatcccaacctgcacaaaagcctggcctcatctccaagtcacctccagtaacaagatggcaaaccaagtatgctcagataagcttttttcataattcaggaataaagtagtccatagaaatgtttctgtttcatatcatttggggcgagtcaggcaaaagtatttgatttgactttatagttttccacagcacaatgagcaaaagacaaacctcgtgggaagatgacactggggcagcccttcctattatttttcttagcccaagaggtctttcactgatacaaggaaaacttgcagaaatgtgatttttcccagatttgtttacatgttccctgggacagatccaggtctgcagatcgacaccagtgggcccaggacctgggggtggctttaaatgaggcttgcagtgttaaaggtcttggataagaagggtcctggggaagaagactctgtggacaagataccagtccccaaaacagcattttcagttccttcttcaattagtttgaaatccagacctgagtttggaagactgattttttgagaccatccctgtgtttggagtggataattgtccctcccctcagccctgcaccagaggtctcatatgttaccccagggagttctcagaggattgggttggcctctaacatgttccttgttaattcttgttctgtaacatgcattcaagaagctaggggaaaaatatctcatgcacttaaataatggtcttcaatttaatttaaaaatattttgacaatatttaatttgtgcttatgtggtgtttggtgtgagtgcagatattgcactgtgtcacctctggatctctgctcagaagcagaacaagtgatgacctaaatgtcaaaatcactgctcgttttcatttggtgaacttcaaactctgttctttttggtcacctgtggaatgaatgcaagcatgattttggcaggaacatttgtacatattctgccgtagataatgtggttctgatggttgttgtgtattttcagtatcactggatccctcagtcttcaccgttttataaacgtataagattaggatgaacttttgaatttacttggtaggaaaaaaagtaggacattattgccatattgtatgtcttaatatttaacttattcggaaatatattccacactgttacatacattttccatggtagaaaggaagttcagtcagtcctgtggaatgaaaccatctcctaaaattcagcatttgcagcattctaaaagcctgtgtaggtacaaggacattgattttgtattcagaattcaagttaactatcttttaaattcgtggttgatgtaagtaataaaaaacattcttaaagttgagggttataagagagattatttctgtggtctaaaggttaaaaagccaacaacctgttaccaattatttcagctttttttgttttaataagtgtgacaacttaaaacttgtttctatttaaagtgaaatgtatctttcaactgtttagttacccagctgtttaatattccagtcttcccaaagtgaaaagatttgtatacaaatgttttctatgatttaataaaaatatatggcacaccaaaaaaaaaaaaaaa

SEQ ID NO: 80 - DNA, 4617 bp, Homo sapiens
atccgataggaccaggtagccactgagcatgcctgtctggtgggcatagcctctgtgcctggtggggtccagccctgtatgtggacttcctgggggaccgcctgcatgctgggaaagtcctgcaactgtgggctctgggccggacccctcctccttggggagcgttgctgtggtctccgcagcctgttggtgtggtccgagaggggactggtgtgtggtggtagggacgcaggtgctcaggagggctcctcaggctgcctctctgcctgttactgctgctccctccctggtcctggggactcgctcaggcctggatgtgtggttttggacaccttggaaagaggttagctgtgagttttgctttgattgggctttgagctgctgagctagatctgtccaagcatgcttttgtggttttctcgagtctttggtcaccctgcgtagaattacctttacttttgccttcattttaggtaatcattaccaaatgaggaggaaaggacgatgtcatcgaggctctgcagcgaggcatccttcttccccatgcagtgttaaacactcccctacgcgagaaacgctgacctacgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgcttcgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaagaaaaaaaaaa

SEQ ID NO: 81 - DNA, 4907 bp, Homo sapiens
ggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaagctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgaaaaaaaaaaaaaa

SEQ ID NO: 82 - DNA, 5673 bp, Homo sapiens
tgccggggccggcgagccaaagaggagccggccgcgcgggccgggaggggacggccgccggagccgcgaggccaactgtcgcctggttgggcccggaaatgggacgtcgcgctttctcagggagcgtagaagcagccagggcctctccaagccgctgctgtgacagaaagtgagtgagctgccggaggatgtccaccgccacgacagtcgcccccgcggggatcccggcgaccccgggccctgtgaacccaccccccccggaggtctccaaccccagcaagcccggccgcaagaccaaccagctgcagtacatgcagaatgtggtggtgaagacgctctggaaacaccagttcgcctggcccttctaccagcccgtggacgcaatcaaattgaacctgccggattatcataaaataattaaaaacccaatggatatggggactattaagaagagactagaaaataattattattggagtgcaagcgaatgtatgcaggacttcaacaccatgtttacaaattgttacatttataacaagcccacagatgacatagtgctaatggcccaagctttagagaaaatttttctacaaaaagtggcccagatgccccaagaggaagttgaattattaccccctgctccaaagggcaaaggtcggaagccggctgcgggagcccagagcgcaggtacacagcaagtggcggccgtgtcctctgtctccccagcgaccccctttcagagcgtgccccccaccgtctcccagacgcccgtcatcgctgccacccctgtaccaaccatcactgcaaacgtcacgtcggtcccagtccccccagctgccgccccacctcctcctgccacacccatcgtccccgtggtccctcctacgccgcctgtcgtcaagaaaaagggcgtgaagcggaaagcagacacaaccactcccacgacgtcggccatcactgccagccggagtgagtcgcccccgccgttgtcagaccccaagcaggccaaagtggtggcccggcgggagagtggtggccgccccatcaagcctcccaagaaggacctggaggacggcgaggtgccccagcacgcaggcaagaagggcaagctgtcggagcacctacgctactgcgacagcatcctcagggagatgctatccaagaagcacgcggcctacgcctggcccttctacaagccagtggatgccgaggccctggagctgcacgactaccacgacatcatcaagcacccgatggacctcagcaccgtgaaaaggaagatggatggccgagagtacccagacgcacagggctttgctgctgatgtccggctgatgttctcgaattgctacaaatacaatcccccagaccacgaggttgtggccatggcccggaagctccaggacgtgtttgagatgaggtttgccaagatgccagatgagcccgtggaggcaccggcgctgcctgcccccgcggcccccatggtgagcaagggcgctgagagcagccgtagcagtgaggagagctcttcggactcaggcagctcggactcggaggaggagcgggccaccaggctggcggagctgcaggagcagctgaaggccgtgcacgagcagctggccgccctgtctcaggccccagtaaacaaaccaaagaagaagaaggagaagaaggagaaggagaagaagaagaaggacaaggagaaggagaaggagaagcacaaagtgaaggccgaggaagagaagaaggccaaggtggctccgcctgccaagcaggctcagcagaagaaggctcctgccaagaaggccaacagcacgaccacggccggcagacagctgaagaaaggcggcaagcaggcatctgcctcctacgactcagaggaagaggaggagggcctgcccatgagctacgatgaaaagcgccagcttagcctggacatcaaccggctgcccggggagaagctgggccgggtagtgcacatcatccaatctcgggagccctcgctcagggactccaaccccgacgagatagaaattgactttgagactctgaaacccaccactttgcgggaactggagagatatgtcaagtcttgtttacagaaaaagcaaaggaaaccgttctcagcaagcgggaagaaacaggcagccaagtcgaaagaggagctagctcaggaaaagaagaaggagctggaaaagcgtctgcaggatgtcagcgggcagctgagcagcagcaagaagcccgcccggaaagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaaccttgtggaatccctttgcttaggcccaacctggtcgatagctcgagaaagaattttttccaaggaaatgtctcggatatgggtactgtatttgaaagctgttagctttgtcaacacgcattgtccttgtcatttgggccccgagctctgaccctcgtgtctgacgcggccacctctttctggaggggctgaggacagatgtgcctgcttgtggagaccaggctgggcctaagcgaagggtcatcgcagccccagcccggagcgtggagcccttggggggtggtcgggtgggatgtgcgttctccgctcgtggtgatgtcaggagctcctcggagggaacagagcggctgtgtatgcagcctgcaggtttccatacactgaagcttttacctcaactttaaaaaaaaaaaaagaagaaaagatttaaaaaaaaaaaaaaaggagactttttttgtaaggttcggcaattttctacggaagtccagcccgctgtgagtccccgcctggctagcgctgcccctgctgctgctgccgcgccacccttgggaaccacttcccgagcttatgtgtatataaatagttatttattaacatcattggtcatttttaaaaaaaagaaaataagaaaaaaccgcagaagaaatgcattcacacagtcgcagagatgcaggccttgccagtggtgtgccgggcgcgggtcctgtctggcggcggcctgtcgtctccaggtgctaactcctgccaccgcgcggtgctcacccacgtctgttcgcgcgctcgcccctgggtttgttgggttttttggtttttttctttgtggtttttttttttttttttttttgtatgaaacttggaggcttacaggtatagacagctttcagctacagcacattctaattttttattttgtttagttcttttgtattcacttctggtctctttaagactgttttaaaagaaatcaatttagggaaccccagttatataatataaactttgtaatctgagagaaaaaatgtatagtaaatctaagtcttgatttttaactttctattgtaaaaaataataatatacagagtttaatagaaggtgatgttttggttttgttttcccagaggctgccatatggtctttgagtacggggatgtcccaaactggcccaccaatgagcatggcggctccggccaggaatgccagagttagcctcccaggcttgcgggtggacatgcctgctccctgccagcctccagtggcctggccaggccctcccgagcctgtctgccctccccaggggtggaggagtctctgggccccaggaggattccctcccggagactcgcacggtgctccctgctcacgcgttgtcacagttagtccggaaatgactgaaaccaggcattctcccggacctcagcgtgggggagcctccaggcagacgctgggtatggagctgtggtgtggtctgtcctgtatggtggccagtgctttctgccagcatttctggatggatatagggactatcattagtatcctaatacacggtgattttaaaacaaccataaaattgattcagagtccactgacccttacagatgtaggtatacccttactggagagggaactctgatgaggagatgctggtaaattatcattttttaaattgctggtgagtctgacacttggtgagttttcagccagtttgttaaacttttaattaagttttgtttataataaaaatataaatggatttgaaagtttccattttttaaagttaccctcgttttcaaaggtattttctaaacagatctttaatggactatttaaaccgaatttaaggaattcacacacgacagttgacaggtcttcacgcaggctggttggtaacgtgctgccagcacagggctgggtgatacgtacaccctaagccgggggtgcctggggctggggggcgctccttgcaatgcccctccagccacagggcagtgaggtgctgcctgtgtgagccgtcgggggagcggccggctgtgggggcagcgcagcaggagcatcgtggggcctttccttctcggctggttctctgtgacggtggcgtcggctcgcctctgctcctttcatctagaaagaagccactgaccctgacagcccacggcgggtacactgagcagctgcattggtgctgtcacttttttaaggctttctgtccagacttcaacactggtttcttttcagagtttcgaaggattaatgacttcctcagcgcccttgctggcgggctgagggtgacagtcacgtccgtttcttctgtattagaaggctgcggtgattcaattagattgtcccactgctgagacctgtagggcagcttctaacatgcttttttcaaggggagaggagtagtgacaagtcgtgtgtcggaattggatttgagaacactctgaatgacccctggaggccgagggggcaggcttcgggcgtgaactgaactccagacccctctttgtgttgggcagtgtcatcttgcttacaaactgtaagacacatttttttgtgtgtttgtttttgttgttgttcttttgcagcactcacgcctctgacagtcttttgggaaagagtaacacccacatacagaatttgtcacatccagagtagcactgttccttaatactggcataatgcttccaggaagtttttcttttttatatttaaaatgttacttttctgtatgatgtgcatgcaagtttaccgtaacttttcttaaactttttagtgccgtttctagtatattcctgtaaatgtcagttactgaaaatgagtccaatgtaagtagtttagcttgtttattgcaatgctggcctcaacacaacagaataaaaatggtagaaagtactctttgatgtttctggtaatcatggacccttctcctggggcatttgttttgttttcataataaaaagcaaaaaaaaaaaaaaaaaaaaaaaaaaaaaaaaaaaaaaaa

SEQ ID NO: 83 - DNA, 4635 bp, Homo sapiens
attctttggaatactactgctagaagtctgacttaagacccagcttatgggccacatggcacccagctgcttctgcagagaaggcaggccactgatgggtacagcaaagtgtggtgctgctggccaagccaaagacccgtgtaggatgactgggcctctgccccttgtgggtgttgccactgtgcttgagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatccccccaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaa

SEQ ID NO: 84 - DNA, 2227 bp, Homo sapiens
gaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagagaaagaaaggagagaagcagattccaggggaagaaaaggggagaaaacggagaagagttaaggaggataaaaagaagcgagatcgagaccgggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgaaaaaaaaaaaaaaaaaa

SEQ ID NO: 85 - DNA, 2699 bp, Homo sapiens
ctgccgcggccccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactgggtgtttaaaaaa

SEQ ID NO: 86 - DNA, 3156 bp, Homo sapiens
tggaaaccagaagagcattttaagaatcataatagttcagtgcagatgttcctgggaggtcaagttaagagtcaaaaataattcattagatttaacaatttagcatggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagaatgtaaagaaaatgaagaatgaatgcatactgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttacatttttaaaaaaaaaaaaaaaa

SEQ ID NO: 87 - DNA, 3660 bp, Homo sapiens
cggctgcgctcaccggtaggccccgctcgggttccgccgaagcccagcccccgcaggtcgcccctccgacgccggcgcgccgcaagggaggccagctcgctcgcagtggggaggtcgcggctccagtcctcgcgtccccgccgtggtcccggtgcctgtcccatcccgcgggcgcggccgttgcgggcggcgcggcccgggcgcgcgcggcgaatctgcggctgcgaatcggctggagcggggcctcgcgagagcggcgaggcctgggcggctgggcctgggcgggcggcgcgggctgctccggaggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttccccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacaga

SEQ ID NO: 88 - DNA, 3702 bp, Homo sapiens
gagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagttgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaaaaaaggtaaaaaaaaaa

SEQ ID NO: 89 - DNA, 4710 bp, Homo sapiens
cgtcgccgccgctgctgccgccgccgctgccacagcctttgccgccacggtctccgccgccgctgtcctcgcgctgcctctgggagcctccattgttccagcagcgcccggtcccgagaccgggcatcttgggggctcgcgaaacgggcggcggccgacggagttgagaccccagggcgccggcgggaccaggagcggcaggggtcagctcaggaatcccggggagccgggaccaaagcgtggggcggcagggggccggggtggcgaggtctacggtctccggagttggggctcccccttcccggcccgactttccccgccgacctccccaagtggggtcggagccccggcgggcgcccccggcgatgagcccggactcgaggtggccgatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggccgtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttgggagagattctgaggataagaactgggcccttaaagaacagctcaagtcctggcagcggctccggcatgacttggagcgagctcggctgctcgtggaattgatccgcaagcgggaaaaactcaaaagggagacgatcaaggttcagcagattgccatggagatgcagctgactcctttcctcatcctccttcgcaaaaccttggagcagctccaagagaaggacacaggcaacatcttcagcgagccggtccctctgtctgaggtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatgcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaaggcctgggtcccaacatgtcctcaacccccgcacatgaggtgggcaggagaacctcagttctgttctccaaaaagaacccgaagacagctggaccgcccaagaggccgggccggccccccaaaaaccgggagagccagatgacccccagccacggaggcagtcctgtggggcccccccagctccccatcatgagttccctgcgtcagcgcaagcggggtaggagcccccggcccagttcgagctcagacagcgacagtgataagtccacagaagaccccccaatggacttaccagccaatggcttcagcggtggaaaccaaccagtgaagaagagtttcttggtataccgtaatgactgcagccttccccggagcagctcagactctgagtccagcagcagtagcagtagcagcgctgcttcagaccggaccagcacaacgccctcaaaacaaggccggggcaaaccctccttctctcggggcactttcccagaggacagcagtgaggatacctcaggcactgagaatgaggcctactccgtgggcactggccgcggcgtgggccacagcatggtaaggaagagtctgggccggggagctggctggctgtcagaggatgaggactccccgctggatgctctggacctcgtgtgggccaaatgccgaggctatccatcatacccagctctgatcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaactgtcaatttagaa

SEQ ID NO: 90 - DNA, 6018 bp, Homo sapiens
attccccctcctcccccgggagcggcggcggcggccgggccggggccccagcgcgggccgggagggggcacggcggaggccacggaggcaggcgcgggagaagaccgcgctccgcttcccgggccgcgccgacctgctcggcggcctgcccgcccgcgcccaggggccccgaacggtggggccgggcaggcggctgaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcaggcagaagcctcctgctgccctttgaagaccgcggagacctgaagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctggcctgcatccgcttgccctgcccccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggc

SEQ ID NO: 91 - DNA, 4411 bp, Homo sapiens
agtgttcttgcagggctgctgatgggtggtcctgttcttttcgcggtcctgtttgcgcagagatgaaacggggaacttagcgtatccctaccgctctttttgatgacaggagtaaagggctgttcagactacctaaacaatgttgttaagagaagcactcgtacttctcagacttcgctgttccggaccccgcgagccaggggcaggcaccgggtccacccggggctgagctgcggcggcgcctgacaatgccccctcgcgccccggcctcggcgcccgctcccggctccagcgcgcctgcacgtacgtagccttcacgtgtgtgtggatacggagtgcatgtgtggagacagaggaatatgctccaacaaatttcggatagaggcgccgaagacaggacgtggggaagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtatttaaaaaaaactaaaaaaaa

SEQ ID NO: 92 - DNA, 6345 bp, Homo sapiens
ctctagactcgaggaattcccgcggcctgggcctgcgccgctcagctctctggaaactagcgcctcagctgcgcggcgcgtaggtcgcggggagctccgaaccgccggcgcccggccatggcggtctccaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccaggtgtaaatgtggtaactcaagaaattaaaccagctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtggccaggaaaattctaaaggatccacctcagaaaaagatggaatgcaccatactgtcaccaagcacagaggtataattacactctacaggcaccagaaagctgcctttgctatcacaagtaggcgaggtcctacccccaaagcagtaaaagctcaaatagcagatcttcctgcaggaagtagtggaaatattcttgttgaacttgatgaggcccagaagccttacctggtacaacggagaggagctgaatttgctttgacaactatagtaaagcattttggtggtgaaatggcagtgaagttgccacatctctgggatgctatggttggcccattgaggaatacaatcgacataaataattttgatggaaaatccctcctggataagggagatagccctgctcaagaattggtgaattctctgcaggtttttgaaacagcagcagcttcaatggattctgagcttcatcccttgttggtccagcatttgccacatctttatatgtgccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctgtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggcaggcattccagaccctccaaacatgtcagcagaattaatccaattgaaagccaaggagcgacactttttggagcaattgttagatgggaaaaaattggaaaattataaaattccagtaccaatcaatgctgaactcagaaaatatcagcaggatggtgtgaactggttagcatttcttaataagtataaacttcatggaattctgtgtgatgacatgggtttaggaaaaactttacagtccatctgcattctagcaggagatcattgtcatagggcccaggaatatgcaagatcaaaattagcagaatgtatgccacttccttccttagtggtttgtccgccaacattaacaggccattgggtggatgaagtaggtaaattttgctctagagaatatctcaacccgttgcattacactggacctcccactgaaagaataaggttacagcaccaagtaaaaaggcacaatctaatagtggcttcatatgatgttgtgaggaatgacatagatttctttagaaatattaaatttaactactgcattcttgatgaaggccatgtcatcaaaaatggaaaaacaaagttgtcaaaagcagtaaaacaactgactgctaattataggattattctttctggaacaccaatccagaacaacgttttggagctgtggtcattatttgatttcctcatgccaggatttttgggtactgaacgccagtttgctgctcgatatggtaaacctatattagcaagtagggatgctcgaagctccagtcgagagcaagaagcaggtgttcttgctatggatgcgctgcaccgccaagtactaccgtttcttttgagaagaatgaaagaagatgttttgcaggatcttccacctaaaattattcaagactattattgtactcttagtcctctccaggttcagctctatgaagattttgctaagtctcgtgccaagtgtgatgttgatgaaacagtttcttcagctacactttctgaagaaactgaaaaaccaaagcttaaagctacaggccacgtattccaggcattacagtacttacgtaaactgtgcaaccatccagcattagtcttaacacctcaacatccagaattcaagaccactgccgaaaaactggcagttcagaattcttctctacatgatattcaacatgcccctaagctctcagctttgaaacaattgctgttggactgcggtttgggaaatggcagcacttccgagagtggcacagagtctgttgtggcccagcacaggatactgatattctgtcagctgaaaagcatgcttgatatagtagagcatgatctcctcaaacctcacttgccctctgtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctctacttctgggaaagcaagtatgaaatcaattcttgaaaacctgagtgatctttgggatcaagagcagtatgattcagagtacagcctggaaaattttatgcattctctcaagtaactatcaaatattgtaaatgcaattgctgctagttcagttacatttctgctgatattcagcaaatttctaagtttatggtgaacttttaactcaatgtgtaaatagatctggagaatattcagcataatgctggctcttgtttcactgggggaaacaagttattctcaaatatttgcactgtattaaatttaaatgttaatgtgaaatggtttaaattttacatgctgaaaagctgcagagcagaggaaccaaaccaggtttatttgtgctaccaggaggtgttcttaatgggaacaggcctcctatctttagtcactttgtacaggatgatatccatgagtactttagtgtttgtatatgttttttcttttaaatagaacttgtttttataattgatttaaaatagggctttttttctataaaagccttaatgagccataattttaagaatataagaataatgactatgatattggtcagtcttagaacatgaaaatgtcagacaatgaatttaatcgggcccttggtggaaacatttatatatttaatgcagatgcatagtgtttttcaaatctttaacatcattttttcaacttttaactataatatcaactattctaaatacaggtaatggtatatttaaggctaccataacatcctatttagagggtggttttt

SEQ ID NO: 93 - DNA, 3308 bp, Homo sapiens
agtcctgttacacctcccgcggccgcgcacagcggcaacccgggcgtgcgggggcgcgcgcggtcagggaggggcctgcggaggcgcgaggcccccggaagcgcctttcccggaaggcagggaggcagcgccggcctccggaggcggcctgggcgatggcggcggagttttgtccataacgtgggcaaccgcgcagctggaggatggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagattcacagttaatagaaggatctctatagttggatttggcttgtatggatctattcatggccctacagattatcaagtgaatatacagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgtaagataagaaacagtttcttagagcagatagaaaaatgcttatttaaatctttgcatgatttaaaaacagattttccattttcttacaactttaagagaaaagaactgggtttaatggtttaaaaaaaagcacagctttttcaccttcatcttgtataatttcatagattggctgacttagggtctttcaatagtttgggaattgaaagattcttgttatatatagctagtttgggtttgtttttgttttaactattttgaaggttaggtgagatgggcaaataggcttaactattttgaaggttggatgaaaagagatgggtcagtattcctacagaattcttattaactcaaataactaaatttcagaaaattaagaagctgactttatatttggtggtttgaagtatcttgttgttagcatttgtaataatgctaaaaaaggcctaataaaatgcccaagaaaatattcagtgcatttatagagaaggatattttgtagtagtatagtaatgtgttatgtagtacagttttaaagctataaatggaattttgtgtaaattcacaaaaatgtgatataaacaggatctaagactggattccctgtcactaaactgcaccactatacctgtctctctgtgtgggggacactgctgatgattcccaagattgagatgatgacggtgatgacgactgggtgaacagccatcacttcaacattgtgataatccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgatatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatctaaagtaatatttcactttatattgtaaagaaggtaggtatattggtggctgaggtctcttgaaattgctaaagggaaatttttctatggtaatgctcttacggatataaacctcagttaaatggaattatctatgggatgtgtggttctggttaactaaaaattaaccagtaaacactctgtagtaaccattacagaaaatacttctgccttaaaaaatatgatatgccagagatgagttagtgtttcttgacgttggagaccttttaaatgcctcatctgttgtactgaacaattgaaactgcatgcagccataaaagggacaagaaacagaactgtttactaactttgggacatcccctggagtttttaaaaataaataaatatatatatatataaaaaaaaaaaaaaaaaaaa

SEQ ID NO: 94 - DNA, 2103 bp, Homo sapiens
aaagtccatgggagccggagcgccgggacgccaagcacttcctgccgcgggcggcgcgccgcagctgcccaggccggaccgggccgggcgcccgcagatgagccccgctagggccgccccgcgctgagagcccagccccgccgctgcccgcccgccatgtctcagatgctgcacatcgagatccccaacttcgggaacacagtgctgggctgcctgaacgagcagcgcctgctgggcctctactgcgatgtgtccatcgtggtcaagggccaggccttcaaggcccaccgggcggtgctggccgccagcagcctctacttccgcgacctgttcagcggcaacagcaagagcgccttcgagctgcccggctccgtgccgcccgcctgcttccagcagatcctgtccttctgctacacgggcaggctcaccatgacggccagcgagcagctcgtggtcatgtacacggccggcttcctgcagatccagcacatcgtggagcgcggcaccgacctcatgttcaaggtgagctcgccccactgcgactcgcagaccgctgtgatcgaggacgccggctccgagccccagagcccctgcaaccagctgcagccggccgccgccgccgcggccccctacgtcgtgtccccctcggtgcccatcccgctgctgacccgagtaaagcatgaagccatggagctgccgccggccggcccaggcctggcccccaagcgcccgctggagacggggccccgggacggcgtggcggtggccgcgggggctgcggtggcggcgggcacagcccctctcaaactgccccgtgtctcctactacggggtgcccagcctggccaccctcatccccggcatccagcagatgccctacccccagggggagcggaccagtccaggcgccagcagcctgcccaccaccgacagccccacctcgtaccacaacgaggaggacgaggaggacgacgaggcctacgacaccatggtggaggagcagtacggccagatgtacatcaaggcctccggcagctatgcagtgcaagagaagcctgagccagtgccgctggagagccgctcctgcgtcctcatccgccgcgacctcgtggccctacctgccagcctcatcagccagatcggataccgctgccatcccaagctctactcggaaggggaccccggggagaagctggagctggtggcaggctctggggtctacatcacacgcggccagctgatgaactgccacctgtgtgcaggggtgaagcataaggtcttgctgcggaggctcctggccaccttctttgacaggaacacgctggccaacagctgcgggactggcatccgctcgtccaccagcgaccccagccggaagccgctggacagccgggtcctgaacgctgtgaaattgtactgtcagaacttcgcccccagcttcaaggagagcgagatgaacgtgatcgccgcggacatgtgcaccaacgcccgccgcgttcgcaagcgctggctgcccaagatcaagtccatgctgccggagggcgtggagatgtaccgcacggtcatgggctccgccgccgccagcgtgcccctcgaccccgagttcccgcctgccgcggcacaggtgttcgagcaacgcatctacgccgagcggcggggcgacgccgccaccatcgtggctctgagaactgacgccgtgaatgttgacctgagtgccgccgccaaccccgccttcgacgccggcgaggaggtggacggggctggctcggtcatccaggaggtggccgcccccgagccgctgcccgccgatggccagagccccccacagccctttgagcagggcgggggcggccccagcaggccccagacgccggcggccgcggcccggaggccggagggcacctatgcagggaccttgtaagcggagctgggtggctgcgcgagggaccgagtactagagctgcttgcatgcgttactaatacaaacaaatgtgatcaagccacttacctactgaactgctactgttgcctgagaaaaatgtgatttttattctgcttgtatttaaaattgatgaaggaaaaaaaaaaaaaaaaaaaaaaaaaa

SEQ ID NO: 95 - DNA, 4556 bp, Homo sapiens
tggccgccgcggctgccgctgctgctgaggcggaggccgcggaggccgcggaggcggaggccgaggccccggcgcagcggggcgcgccccgggcccaggcccggccccagccgccgctgcggagcccgccgggaccccccggagcgcggccacggcgcagccgctgccatggcccagacactgcagatggagatcccgaacttcggcaacagcatcctggagtgcctcaatgaacagcggctgcagggcctgtactgtgacgtgtcagtggtggtcaagggccatgccttcaaggcccaccgggccgtgcttgctgccagcagctcctacttccgggacctgttcaacaacagccgcagcgccgtggtggagctgccggcggctgtgcagccccagtctttccagcagatcctcagcttctgctacacgggccggctgagcatgaacgtgggcgaccagttcctgctcatgtacacggctggcttcctgcagatccaggagatcatggagaagggcaccgagttcttcctcaaggtgagctccccgagctgcgactcccagggcctgcatgcggaggaggccccatcgtcggagccccagagccccgtggcgcagacatcgggctggccagcctgtagcaccccgctgcccctcgtgtcgcgggtgaagacggagcagcaggagtcggactccgtgcagtgcatgcccgtggccaagcggctgtgggacagtggccagaaggaggctgggggcggcggcaatggcagccgcaagatggccaagttctccacgccggacctggctgccaaccggcctcaccagcccccgccaccccaacaggctccggtggtggcagcagcccagcccgccgtggctgcgggagcagggcagccagccggtggggtggcagcagcagggggtgtggtgagtgggcccagcacgtcggagcggaccagcccaggcacctcaagcgcctacaccagcgacagccctggctcctaccacaatgaggaggacgaggaggaggatggtggcgaggagggcatggatgagcagtaccggcagatctgcaacatgtacaccatgtacagcatgatgaacgtcggccagacagccgagaaggtggaggccctcccggagcaggtagcccccgagtcccgaaatcgcatccgggttcggcaagacctggcgtctctcccggctgaacttatcaaccagattgggaaccgctgccaccccaagctctacgacgagggcgacccctctgagaagctggagctggtgacaggcaccaacgtgtacatcacaagggcgcagctgatgaactgccacgtcagcgcaggcacgcggcacaaggtcctactgcggcggctcctggcctccttctttgaccggaacacgctggccaacagctgcggcaccggcatccgctcttctaccaacgatccccgtcggaagcccctggacagccgcgtgctccacgctgtcaagtactactgccagaacttcgcccccaacttcaaggagagcgagatgaatgccatcgcggccgacatgtgcaccaacgcccgccgcgtcgtgcgcaagagctggatgcccaaggtcaaggtgctcaaggctgaggatgacgcctacaccaccttcatcagtgaaacgggcaagatcgagccggacatgatgggtgtggagcatggcttcgagaccgccagccacgagggcgaggcgggtccctcggctgaagccctgcagtaacccgcccagcctcccgcggggccacacacttcccctcccaacacacacacacacctgccatcttggtcatgagctactgtctgtccctccccaggacccgcggtgggtgctgcatgttcccggccctctgcccctcctgtcctaccccctttccccaccgagagctgggccgggagaggaccgcagggcaggtggcgtgaggtccgtgttgccttctttaacacacactcgtgcagtgggggagttctggctccccaacctaacccctagccgtcatctccacactcaccaggcccaccaggggagggggctggcctgggggtcttgggaaggcccctccccaggccctaggccacctcgcggaagccttcagcctccgcccctcactgcagccccttgggacttgaggggggccccaggggttctcaggacccctcccaccacctcccagtgcttccacgtctccaaaagcgccttcctgtcaccctcgtctatccctgcgcctgggggctggggtaggcgaggccgtggggactacccattttatagctggggaaacaggctccgagaaattgcacaaccgacctcaggtggccggcagtggcgtgcctggtgccctttctcctcttccgcctctgttgctccctttggtcctctggggcctcagagaggcaggtcctaaaggagggggggtctcctgggggcagaccgagggtctcggaggatagaatgagaggtttccagggctggcagagtgtgtgcgtgtgtgtgtgcagaagttttgctttcaaacaaatgaagatacaagaggcagtaggacctgggttggaacccaggggagcagactggggggctgttgcccctccctccatctccccacacccaccccaccccacagcagggctcctggcccccacccccctgtacataatttttaaaacctttttttagcgaatgaaatattgaagtataagattccttttatttttcaaaccaatggggctgtgtctattgtccccctcggtccccaggggtggggggccttggaaggcagggcggtgttggggggctggggggcaggctgaatgtgtgtgtgtgggtgtgtatgtgtggagtgtgtgtgtgtgtttccatggtaggactccagtcccagctgctgcctaggctcctgtgggtcctgtgggtccccctcccctgttcaccttccccaacagggctatagtttaagggtgtcccaggccttggctggttggctgggcccagctcctgggggctgggcagggcagggcagggccgggtccacttccattgttagcagttgtttgcagaattttctcttttaccattcctctctttttgttctcgcccagagtgggtggttttttgttgttgttttagattttcatgtgaaggcagttttttttcttttttaactccccatccccctatgcagggtgtcatttcaccatccacatccacatccttgtttgtgtttctggccctcgtcctccctgcctctcatctgcctccccaacccccacctacccactgctcccaggggtctctccaggggcagggggattttaggagatggggtgggggccagcccctactggacccttgtaatctgatttggagaccatccccccgatgggaccagcagccccgccggcccactgggggtccctcttaacatctgcttgttgcgggggtcagtcatgagtgccagggtctggctggggtcttggcactgtcttcctggccggggcctgaaaccttagcccccagccggcctgagtgggggatattgacacccccagctaaagcacaagcaccttagtcacccctcctctccccccgcctcctggcctgccaccccaccccagcgtttaccccaaagcacaatgccctggtcacttggcaagcggctgggcctgacggaggccgaggggcagaccggggctccagccagacccctgaaaggaaggtgctcccccacttccaggccttagttggggtgggggggccagctcctgggcctggggtcttctcacccccacccccttgtcctgggtaggcccctgcctgcccctctctgccttttcctcgggtgtccctcctcgagcccctgtggcattggcttgggtggcagagcccacttgtttcagggaccccaggaggtgccccctggctcccaggactgtgtgtgggtccggggggtgggggggtggggagaagggtcgggcagggggtgcaggggaggaaactcctcaccaggagagccaaagacagggttgtgccttaccccaggagccacccctgtaccccccttgccctgccattcaccctccacccctacccctgggcggcctgctgctttttccttctcttcctcccctgccctgagctgcatggttcccccaccctgggcagccaggaaggaatctgaatggagaatcaccaaccaccagagaaaaaagactgtggggccctcccctgccaactccccttccctggccgcccactcaacccacacctctttcacgcaggacaggctgcccaccctgtccacgtgaagtgccaacgccctccccaccctgggccgagcccccacccctccctgggcccccaagtgagattgcacatttaactactgtaaggagaggagcggcgttggcaaatgtgaaccatgagaatatcagtgatactgatgagaataaactaaacgcctttgtaacaaaaaaaaaaaaaaaaaaaaaaaaaaaaaaaaaaaaaaaaaaaaaaaaaaaaaaaaaaaaaaaaaa

SEQ ID NO: 96 - DNA, 2656 bp, Homo sapiens
atggcggcgggtgggagcggcgggcgtgcgtcgtgcccgccgggggtcggggtcggcccgggcacggggggcagtcccgggcccagcgccaacgccgccgccaccccggcccccggcaacgcggccgccgccgccgccgccgccgccgccgccgccgccgcccctgggccgacgccgcccgccccgccgggccccgggacagacgcgcaggccgcgggcgcggagcgggcggaggaggcggcgggcccgggggcggcggcgctgcagcgcgaggccgcgtacaactggcaggccagcaagcccaccgtgcaggagcgcttcgccttcctcttcaacaacgaggtgctgtgcgacgtgcacttcctggtgggcaaggggctcagctcgcagcgcatccccgcgcacaggttcgtgctggccgtgggcagcgccgtctttgatgccatgttcaacgggggaatggccacaacatccacggagattgagctgcccgacgtggaacccgctgccttcctcgcactgctcaagtttctctactcggacgaggtgcagattggcccggagacggtgatgaccacgctatacaccgccaagaagtacgcggtgccagcgctcgaggcccattgcgtggagttcctgaagaagaacctgcgagccgacaacgccttcatgctgctcacgcaggcgcgactcttcgatgaaccgcagctggccagcctgtgcctggagaacatcgacaaaaacactgcagacgccatcaccgcggagggcttcaccgacattgacctggacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggcccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgcaaaaaaaaaaaaaaaaaaaaaaaaaaaaaaaaaaaaaa

SEQ ID NO: 97 - DNA, 4857 bp, Homo sapiens
cagactcacgcagctccagcccatcttgctgacctaattcagaaaagaagtgctacagctctgtgcctgtcatctttgcagtgtagcattttcaggtgatctaggaaacagttatttttatgagcaaataagagaaacaggaatcatgatggggatatatttaacagacccagtactggataaaacttaaagccagtttctattcaacatagtgaaaaggtcaccttgcctggctgagaaaagcagcaaaatatcagctttgttggtttcagttaacctcttagcccgggctaatctcttttccttgatgttcaaaccaatttgggatatctaactctaaagagagacacactgtactcatggtagatgacaaggaaaagaacatgaaatgtctcaccttcttcttgatgcttccagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaattgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacattctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaacaatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagtcacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcataga

SEQ ID NO: 98 - DNA, 2217 bp, Homo sapiens
tttagcttgtgctcaagtcctcttgctgtgttttcagaagcactcacatgttctttcttttcctgagtgaaaagcaaaggtcccacggtgtgtgctgtggtgcaccgcctggctttgggggtcccggaggcaggctgcctagactcacagcctcgggaccgttgccacggcctgtcttctcgttcaggcctgcctctgacagcactcaccatgaggacattccatccttcaccccctcctctggcacaggccaccactgcggtgctgtgccttcagatgggaggtgggcgcggtggccgcctccttccctccaggacctgcccgtgtgaagaccccccggagtgctgagcttcagggctgcgtggaaagagtttttactctctttttctagcctgtataccaggcttttccccacattgtcaggtagagcaccagcttccctgaccgctgctgctcggggagggctggggctggccgggggtcctgtggaggagtacatggaggactccaggtacagcgcaggagtcacggcttttgttttttgacattggcccccggttctaccaatgacagggtgccctggctggagctgtcatcacacacacccctcagctcggaggctgtgggctcctcaaagctggagaaagaggccaagatttttctgcacacggagtgtggggataggagccgggccaagcgctggcccctcagcggtgagccctgcccactcttaccgagcaaggtgggtggctctggcacgagtcccccagggggagagcatggctaccagggagctgcagcggagccctccagccctcaccccaggccagccccaccccggcctctttgagaattctcagaactttgtacctttcccctgatttttaaaccctttttctaaacagactgactttcttacaaaatgcatttggaaaccagacctttgctacccaccaatgtctctgggttttgtaccagtccctgctctcaggccaccctgcccaggacccgggcccgcctccccctccacactcaggatgtcctgctccatctggccggctcactccgtgtggcctgcctttgctgaccgttttggggttccccgccggagctacaggggcattttcttccctaaaaccaacagtgtcccactgacctccccaagtgtttgctgcgtggcagatttcctgttcttgttcgcagtttgccgactgaagagtgtgggatttccgaggcccaggtgagcacgtccatctcaggaggcgtggagggaaaagacatgtcatgaagggttttttttatgtgactgatttttttttaaatcgatgttcaaactaataaatatttttttatgaagaggaaaaatgtgtagattacatttcacattttgtatttttgtttgtgtctgtttgtattttggtgtttacaacaccaaagtgggaaatacagtccattggggatggtgttatttgggggcggggagggggcagggacaccacgatttttctgtcaagctctggatcctgaccaggttgtacactggggctctctgagctttgggacacaggacactgccagggctacgtagagaactgactcagaagacgcagcttactgcttccaactttgcacatcttcctctttaaaaaactgagaaaatgcaaaaactggaactttttgcaatattataaaagaagtaatcttattttagctcattctgtgacatgtgcgactcttaagaaagccatacttaatggtggtggttttttttagatcttatattgtgttttgtatgcagcccttttagaactacttgtagtgagggtgctgtgtgtgcttttcttaaatatttatttttttcaacatgctttcaacctgtcaacaaaaacaaaacacacaaaaaaagggcagtgtttgaagattgttgatttttttctggggataatctatattatattgacttcctattacttattataaacctgtgtttgtattggagatgtgtctactattgggggaagaggttctcgtaatcgctcggtgggaaatcatggctctgccgtcctgcctctctgtggccgtgggttcacgtggcctctgcggtgagtctccaagtttctgcctaggcgcctgtgcgtttcctttctgtgacgggattagcttagacatccttgcaaagcgatcactttcaataaattgggaaattgctgctccagc

SEQ ID NO: 99 - DNA, 590 bp, Homo sapiens
ctttatctttgatatttcctatttttaaaaaaacttatctgtgaattgatttaatgattgtgtatataaatctgccaaaattatttcaatggatgaaacaatgaatcagtacctatttatatgctgccaaggcacacctataattttttaaatgatgataagagtagcctaaagcagtgagcagacatctcagaaatttcagtgtaagtggttttaacttgcaacatgatgccaaaaaacttagaacagggagctgccatcttgcatccccgtgtgtgtgcacctaatctcagctggttccccccagaccccctgagcaccaaccctagtcccccgcgcagccccttatccgctgcgacaagatgaaagaaacaatcatgaaccaggaaaaactcgccaaactgcaggcaaaagtgcccattggtggaactgctcacagaaagaaggtggttcacagaacagccacagcaaatgataaaaaacgtcagttctccttaaagaagttagaaatctctggcattgaagaggtgaatatgtttacaaaccaagcaacagtgatccgttgacctgcaggtgacctcgaggggggg

SEQ ID NO: 100 - DNA, 444 bp, Homo sapiens
  modified_base (417)..(417): a, c, t, g, unknown or other
  modified_base (440)..(440): a, c, t, g, unknown or other
ctttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctatacattttgaagatgaaatttttagccttaaagtttatattctcaagtccttttacaatcagtgtgtctcctgaactagcacacaggctgtagaaacagtcttagaaatcattgaaagatttgattatgaaagaatagcaaaattatatttcttgacatataaaaagttggtttaatgcctttatttccctttaaggaccagaaccaggaatactatatcgaaaaattagtctgtggatttnacactgacttagcatatagcttnaagt

SEQ ID NO: 101 - DNA, 2965 bp, Homo sapiens
gggcatggagagatggcgcaactgcggcgcggacactcgacattcagggacgtggccatagaattctctcaggaggagtggaaatgcctggaccctgtgcagaaggctttatacagggatgtgatgttggagaactacaggaacctggtctccctgggaatctgtcttcctgacctgagtattatctccatgatgaagcaaaggacagagccctggactgtggagaatgaaatgaaagtagcaaaaaatccagataggtgggaaggtatcaaagatatcaacacagggaggagctgtgcagtgagaagcaaagcaggaaacaagcctattacaaatcaacttggattaacctttcagttacctctgccagaactggagatatttcaaggtgaagggaagatttatgaatgtaatcaagttcaaaagttcatcagccacagttcttcagtttcgccacttcaaagaatttactctggggtcaaaacccacatatttaataaacataggaatgactttgttgattttccattgctgtcacaagaacagaaagcacacattaggagaaaaccttacgaatgtaatgagcagggcaaagtcttcagagtgtcttcaagccttcctaatcatcaagtaatccacactgcagataaacctaacagatgtcatgaatgcggtaaaaccgtcagggacaagtcaggcctcgcagaacattggagaattcgtacaggagagaaaccttacaaatgtaaagagtgtggcaagctcttcaatcgaattgcataccttgcacgacacgagaaagtgcatactggagagagtccttacaaatgtaatgagtgtggcaaggtcttcagtcgaattacataccttgtacgacatcagaaaattcatactagagagaaacctcataaatgtaacaaatgtggcaaggtttatagtagcagttcatacctagcacaacattggagaattcatacaggagagaaactttacaaatgtaataaatgtggcaaagaatttagtgggcattcaagcctcaccacccatctgttaatccacactggagagaaaccttacaaatgtaaagaatgtgacaaagcttttaggcacaagttctccctgacagttcatcagagaaatcataatggagagaaaccttataaatgtcatgaatgtggcaaagtcttcactcaagtttcacatcttgcacgacatcagaaaattcacactggagagaaaccttacaaatgtaatgagtgtggcaaagtcttcactcagaattcacaccttgcaaatcatcagagaatccacactggagagaaaccttacaaatgccatgtgtgtggtaaggtctttaggcacagttcatggtttgtacagcatcagagaagtgttcatgagagagtccttacaaactgagtttggcaaactctatcataagttctagcagtaatcaacatccgagagtctatactagaaagaaatcatttaaatgtactatatgtggcacaggctgtatcgagacctaccaaatcactagacatcgaaacattcatccttggtgaaaccacacaaatggattgtgtgtgccaaggccaacaagtcaaaatatgttgaacctaatgatatgatgtgtataaagggtgcaaggacacgtggaaatgatctgtaatattcgggttattaaaaatgtaattggctgggcgcagtggctcacacctgtaatcctagcactttgggaggttgaggcaggtggatcacaaggtcaggagtttgagaccagcctggccaatatggtgaaacaccatatctactataaatacaaaaaaattagccaggcgtggtggcacatgcctgcaatcccagctactcgggaggctgaggcaggagaattgcttgaatccaggaggcagaggttgttgcagtgagctgagatcgcgccactgcactccaacctgggtgacagagcgagactccgtctcaaaaaaaaaaaaaaaaaattatttgggtttgaaaggccaggggcagtggttcatgcctataatctcagcacaatagaaagccaagacaggagggtcacttgatgcctggagatcaagataagtatgggcaacgtagcaaggcccatccctacaaaataaaaaaaataagccaggcccttggcatgtgtctgtagttccagctactcaagaggccgaggcaagaggattgctcaagcccaggagtttgagagtttgagcagtgagctctgatcttgccatttgtactccagcttgggtgacagagcgagaccctgtctcaaaagaaaaaaaaggctagtttttatgacttcaacctgaactttgaaatttcttcatgtgccttccctacaggcctttcactgtggtctgggaaagaatcagtaagatgacagggctgacttcattagatgaggagcgtttctatccagtttcctggaggaataaggacactgccttttcagattaaagattgtctgatttagagaccatggaggtggacagagaataacaaaaccgtgatggcagtcatcatgcttattgcagttagcacacacttttcctgacaggcacagtgctgctgtgctctacaaatgaccatgaaatagagcacgccatgactttaggacacagggatttttatgggaagagagttcatcagggactgattacgtaggagagacgatgcaggggaaatggtggccaccgtctccattgaatagcaatagctgctgtttagcaaagactgattaaaaagtactctgatttttcaaatggaagagagaacagttaaatcagagtagagagtttaatcaaaactaccagtggaacatgttcttgagtaggattcacatttaactgctggcataatttgcaactgttggattttctcatgtttggaacaataaagttgaaattttccaaagtgaaaaaaaaaaaaaaaaaaa

SEQ ID NO: 102 - DNA, 3249 bp, Homo sapiens
cagttgcgcccggcagcgacgggaaacgtctctgaattaggtgttccgctcgcctcttgtgcggtgtggagctgcgcgccccccgccgaggcgggcccaggtgccttctccaagagaggcagcagggagggagaaatggcaaggaggttgctgccagcccatgtacaggagtccgtgacgttcagggatgtggccgtgttcttcagccaggacgagtggttgcacctggactctgcccagagagccttgtaccgggaggtgatgctggagaactacagcatcctggtctcactggggattctcttttccaagccaaaggtcatctcccagttagagcaaggagaagacccctggatggtggagagtggagttccccaaggcgcacatctcggatgggaaagcttgtttggaaccatagtttctaaagaagaaaatcaggaagtcatgaaaaaactcataattgatggcacatttgacttcaagttggagaagacctacataaatgaagataagttagagaagcaacaaggcaaaaagaacagacttttcagtaaagtgttagttaccatcaaaaaagtctacatgaaggagaggagctttaaaggtgttgaatttgggaaaaatcttggtctaaaatcatcgcttattagaaaaccgagaatagtttccagaggaaggagaccccgttcacagcagtattcagttctctttaaacaactgggggtcaacacagtgcgtaaatgttataaatgtaatatctgtgggaaagtcttcctccacagttcctccctgagtaaacaccagagaatccacactggagagaagctctataaatgtaaggaatgtaggaaagccttcagccaaagctcatccctaactcagcacttgagggttcatacaggagagaaaccttatatatgtagtgaatgtggaaaagccttcagtttcaccacatctcttattggacaccagagaatgcatactggagagagaccttataaatgcaaggaatgtggaaaaacatttaaaggtagttcatctcttaataatcaccagcgaattcacacaggagagaagccctataagtgtaatgaatgtgggagggccttcagtcagtgctcatctctcattcagcaccacagaattcatactggggagaaaccgtatgaatgtactcactgtgggaaagccttcacttcaatatcgcggctaagtaggcaccatcgaattcatactggagagaaaccctttcattgtaacgagtgtggaaaagtattcagctatcactcagcccttatcatacatcagagaattcacactggtgagaaaccatatgcatgcaaagaatgtgggaaagccttcagccaaagctcagctctcatacaacatcaaagaattcacactggagaaaaaccctacaaatgtaatgaatgtgggaaagccttctcttggatttcacggcttaatatacatcacagaattcacactggagagaaaccatataattgtaaggaatgtggaaaagccttcagttcccactcaggcgttaatactcatcgaaaaattcatactggagaaaaaccttataaatgtaatgactgtgagaaagccttcaaccaaagctcagctctaattcagcaccagagaattcatactggagagaaaccatataattgtaaagtgtgtgggaaagccttcagacagagttcatcccttatgacacacatgagaattcatacaggggaaaaaccttataaatgtaaagaatgtgggaaggcttttagtcagagctcatctcttactaatcatcaaaggactcataattgagaaaaactgtataaatgcatgtaggaactgaagttatattccatactgagtatcaaaaaattcattgtggggagaaagtgatgaagagtagttaatcataggtaaaacttcagcattagacctcatcacacatcagagacttcatgatgcagggtaaccttgggaatgctagaaaagcttctataaaatgtttattcatatgttcttaagttattaccatgaaatggagaatttttaagattgcagggttagtatttgattgtctagtgatgtacgataacagccaccagctttcctgagcatcactgggaagcctgctgtttatgtacaagtacagccataaaatccagacacagataaatctaggaatctattttttgaaactattatgcaagccagtggtactagaaagaatgttttagaaaagaaatatgtacaggtgacccatagctacctcactgtcactaaaatgttttttaataatcttaaagcagattctgcacttcatggtaaagactttgaattgtttctctgctttctaagccattcacctgagaagaaaatcactccataaactatgcagacgtactgtctttgcgttttcttcctacttgttccaaactctgagtcagatctaaagtcactttaagtcacagaacgcatggtatttcacttgtttttctcattaaaagtgattacctttgctgtattaaattgataagtaaaggtcattcagacaaccactgcttttgcaatttactgaaaaatgttataaattatctcagaatgtagccaatagcaagcacagctcagctcccagggtctgcctgcttctgtgagccttctggttaccagccaccagaaggcccaggaacaatgtagaactcaggtcatcatccttggaggtaaaatgaaccagatgattttcacccttacttccactttttcaccttcatcagacaaggttcactttctccccacactctaaaggtcactgggcaaatatttaggctctgagttcagatactctttcttccagcaaatggacttacactcttcaacaagtgatttagctcatttcagcatttctaaaatgtgaatcataagattagcaagctaaaaacagttatctcacaagtcaaaattgttgggctttacagaggctaacatctagtttagccaagtttatcaggagggggcaagcacttaagggctgaaacgacccatttcataaagtgctaagtttttctgccaaggaactttaaaaaatagaaaactggctgggtgcagtggctcacgcctgtaatcccggcactttgggaggccaagacgggcagatcatgaggtcaggagatcgagaccatcctggctaacatggtgaaaccacgtctccactaaaaatacaaaaaaaaaaaaaaaaaa

SEQ ID NO: 103 - DNA, 1554 bp, Homo sapiens
ggggagggggcagtgtcctccgagccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcagggccctctgcctccagccagagaggagtccctcctgggcgctccctctgagtcccatgctggtgcccagcctaggccccgaggtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagcagcttgaaaaaaaaaaaaaaaaaa

SEQ ID NO: 104 - DNA, 5745 bp, Homo sapiens
cacagggcctgcagagaggggacccaccgggcaggatgcactggcttccagcaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatccccccccagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgaccctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaagctggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggcaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctg

SEQ ID NO: 105 - DNA, 4278 bp, Homo sapiens
ggctcgacccggaagccgccgtggccgccgcacaagctgcgctcgtctctcggctggggagctccgtgtcgcaccgggttcttgggctggccgtgtccttctccctcggtcgccactggcccatgagtccccatggcgacggcaggggccaggcccaggggcgggcagtccgagtggggctgcggcgctccgggggcatccgcggcggcgtggcggtgttcgccgccgtggccgcagtgttcaccttcaccctgcccccttcggtaccggggggagactccggggaactgatcacagccgcacatgagcttggagttgcccatcctcctggctatcctttgttcacgctggtggctaaactggcaattacactgtttccttttggttcaattgcctaccgcgtcaatcttctctgtggcttatttggagcagtagctgcatcattactttttttcaccgttttcaggctttctggctcatctgctggaggaatccttgctgcgggggtgttttcattttctcgtctaacatggcagtggtccattgcagcagaggtttttagcttaaacaatctctttgtggggctgcttatggctcttactgtacattttgaggaagcagcaactgctaaggagagatcaaaggtagctaaaattggtgctttctgctgtggccttagtttatgtaaccagcacacaataatactctatgttttgtgcataataccttggattctctttcaacttttaaaaaagaaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaaggacagacagaatccatcattagtatggctttttactggaatgttttgcatttattcattgttctttgcttggagagcaaatttagatatttcaaaaccacttttcatgggtgtggtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacagtgtttgtgaccaaaggaccaactatgtgattgataagttcgcaaagaaccttctcacctctatgcctcatgatgcaattatcttactcagaggagatttgccaggaaattctctccgttacatgcattactgtgaggggttgaggcctgacatttcattagtggatcaggaaatgatgacttacgagtggtatttacccaagatggcaaagcacttgccaggtgtcaactttcctgggaaccggtggaatcctgtggaaggaatattacctagtggaatggtcacatttaatctttatcattttcttgaagtaaataaacaaaaagaaacatttgtttgcataggaattcatgaaggcgacccaacctggaaaaagaactattcactttggccatgggggtcttgtgacaaattagttcctttggagattgtattcaaccctgaggaatggattaaacttacaaaaagtatctataactggaccgaagaatatggaaggtttgatccatcttcttgggaatctgtggccaatgaagaaatgtggcaagcgaggatgaaaacaccgttcttcatctttaacctggcagaaactgctcacatgccttcaaaagtgaaagctcaactctacgctcaagcatatgacctttataaggagattgtctatttacaaaaggagcacccagtgaattggcacaagaactatgccatcgcctgtgagcggatgctgcgtcttcaggcaagagatgcagatcctgaagtgctgttatcggaaaccatcagacatttccgtctgtactctcagaaagcaccgaatgacccacagcaagctgatattttaggtgctctaaagcacctaagaaaagaactgcaaagtctgagaaataggaaaaatgtctgagacagcaaaatatgaaaaacctgctcatcgttcagcttccaaaattctgaagtctggaagtttttccttcaagaaaagaaactgcataaaaaatttaaaactaagtcatctcccagatataagtatcatggtccagcagtactgtttaatggggtattcagtgactaaggtctgctatttatgcaaaattctgtttatcccgtgttaccaaattaccatttcagtgagaagcttttgaaaagtcttctgacttccagtctttcaccagatgactgcactggattagattctagaagagaatgaaccattttcatataactaaatattggtcatgaactgtgtaagggccatgcttattgggatcagttttaaagttaaattcttttgatattaataccagaccaaagacattttctgtttcctggaaaaaaaaaatgaatcatgttaggctttaggtgagagtacattttttacaaagtagctatagttgttacatagtcttacacttcaagctaaacaccaaatgggtgatattttgaaaaaagtttgtgttttactgtcttagatcgttcttggaaatcactaaaaaaaaaaaaagttaatttgatgtttgcttatttcagttgcagaaactggcgagtaaaaaagattttgcatttacttaattaattttatatttatgttttatttctatttggactcagagatctagacccaataattagtaggctcctgctgccaaaatgcaaaggggaaaaaaaggcagggattgggggggatggggaagtggcccaataaattcatttctgttacaagcatcttttatacatattactaaagagaacatagtaagaaatgcaaataatagttctttattttattatgacagttaattaatagcaacctgttttaatgaataaagtcactcagagtccttcagcacttcctaagtagaggccagaatctgtagggcttcttttccccccaattgtatagctcctagactccaagcactatataggcccctgtatagaaatgctcactaatgaagagggagggctagaagcttgtctgcattcaaagatcactggtgagtcattcagcaagaaaaggccccttaccaggaatagtcacagttccgtggcattgtactagcaaaagggtctgatcaaaggtctcctgtggagcttgcatggttccctttcatactacgaccataattaaaaccactaattctcttttaaaatgctgcaggatgccatgtaggcatctgtctggagtgtcctttgtgatgtcataagctgttaaggaccagtgccgagggcttttgagtgaaatgccagtcatgaaggtgcttcaagacaagggtgcctctaaaagcttgacagggccttgactgcacaattcgagctgaatttgccccttgtcagctgccagtaaataaatctcaaagggggaaaagctgaagtttcattacctgatccatggggctttgttggttttggcatcacacaggggaagctcttgcccctccattctctggatttgaagatgtccattggagcctgcagtgcctggacagggttcagagcggaaccttttgaagagtgtcaatagttgtaacagttcagctgttaggaagacaaataaatggaggagctcattaatccgcttttggctctcagtgccttttgcccttttatcacagccttattaggctcctactcatcttgaaccagaaaaaaatgaattgaagttgttgagtactaattggcaaagacttttaatcatgggccaagaactttcactgacttgaaagtaacttctccacagggaaggaccaaaaacctggtttaccttaaaacaaaaacctgttggagttcagcgtggtgtaaaaatgtaaggaagcattgataaattgtctaagtttatccatttgaaagaaattgtgtaagattatgatattctcttttctttaaaaaaaaaagtacaataaaattcaaacattccttaggaaaaaaaaaaaaaaaaa

SEQ ID NO: 106 - DNA, 4792 bp, Homo sapiens
caactagaggagctcgccccctgcctgtgacagcttagggtcgcctactttttgtggacacactgccgtccacggagtgcagaggccgcctgcagttttcttgcgtccctgtgagacgcacggtggcgcaattcccgagcgtgccaatcccgggctggctggagggcgggctcttcaaatttgaattgcggaagtgttttgtgtgttagagaacgtcgcggaggaggtaagcgtcgcttggcgcctggccgccgcgggcaggatacaccgtgggcctgaggcgcgagcccggcggcgtgcggccctctctccgcgcggagccgagccggaactgcggcagtctctccctgccaggctcttcatccaaggtttctgtggatcccttctgaagttctatctgaaaattgcgcttaagtgaattttctgttagaagaacttggttgctactttcttgtcaagatgattgcaacacctttgaaacattcaagaatttacttacctccagaggcatcttctcaaaggagaaatctacccatggatgcaatcttttttgacagcattccttcaggcacacttactcctgtaaaagatttggtgaaatatcagaactcctccttaaaattgaatgaccataaaaagaatcagttcctaaaaatgacaacttttaacaataaaaatatatttcaatcaactatgctaacagaggctactacctctaacagttctcttgatatcagtgctataaagcccaacaaggatggattaaaaaataaagcaaactatgaatcaccaggaaaaatatttctaagaatgaaagaaaaagtactgcgtgacaagcaagaacagccatcaagaaacagtagtttgttggaaccacagaaaagtggaaataatgaaaccttcactcctaacagagttgaaaaaaaaaaattgcagcatacctacctatgtgaagaaaaggaaaacaacaaatcattccagtcagatgacagttcactaagagcctcagtccaaggagttcctctagaatcatcaaataatgatattttcctcccggtcaaacaaaagattcagtgccagcaggaaaagaaagcaccactgcacaatttaacttacgaacttccaactctgaaccaagaacaggaaaattttttggctgtagaagcccgaaacaagacattaactagagctcagttggctaaacaaatttttcactcaaaggagagtatagttgcaaccactaaatccaaaaaggacacgtttgttttagaaagcgttgattctgctgatgaacaatttcaaaatactaatgctgagactctcagtactaattgtattcctattaaaaatggcagcctgttaatggtttctgatagtgagaggacaacagaagggacttcgcaacagaaagttaaggaaggaaatggaaaaacagtgcctggagagacaggtcttccaggttccatgaaagatacatgtaaaattgtacttgcaacaccaagacttcatataacaatacctcggaggtcaaaaagaaatatttcaaagctttctcctccaagaatatttcaaactgttacaaatggacttaaaaaaaatcaggtagttcagctacaggaatggatgattaaaagcatcaataataatactgctatatgtgtagaaggaaaattgatagacgtcactaacatatattggcacagtaatgtaattatagagcggattgagcacaacaaacttaggactatatcaggcaacgtttatatattaaaaggcatgatagaccaaatttccatgaaagaagcaggatatccaaattatctcataaggaaatttatgtttggatttccagaaaattggaaagagcacattgataattttctggaacaattaagggctggtgaaaagaacagggaaaagaccaaacaaaaacagaaaactggaagatctgtccgtgacataaggaaatcaatgaaaaatgatgcacgagaaaaccaaacagatactgctcaaagagccaccaccacttacgattttgattgtgataatttggaactgaagagtaataagcacagtgagtcaccaggagctacagaattaaacatgtgccacagtaattgccaaaataaaccaacattaaggttcccagatgaccaagtaaataatactattcaaaatggaggaggagatgacttatctaatcaggaattaattggaaaaaaagaatataaaatgtcttcaaagaaactaaaaattggtgaaagaacaaatgaaaggataataaaaagtcagaagcaagagacaactgaagaattggatgtatccattgatattctaacctcaagggaacagtttttctcagatgaagaaagaaaatacatggccatcaatcagaagaaagcttatattttagtaacaccacttaaatctagaaaagtgatagagcaaagatgcatgaggtataatctgtccgctggcaccatcaaagcagtaacagattttgtaataccagagtgtcaaaaaaaaagtcccatcagcaagtccatggggactttagaaaatacatttgaaggtcataaaagtaaaaacaaggaagattgcgatgaacgtgacttacttactgtcaaccggaaaataaaaatatctaaccttgaaaaggaacaaatgctcacctctgactttaagaaaaataccagactattaccaaaattgaagaaaatagaaaatcaggtagctatgtcattttataagcatcagtcctcaccagatttgtcaagtgaagaaagtgaaacagaaaaggaaattaaaaggaaagctgaagttaagaaaaccaaagcaggaaacaccaaagaagcagtggttcacctgagaaagagcacaagaaacacaagtaatattccagtgattttggaacctgaaactgaagaaagtgaaaatgaattttatatcaaacaaaagaaagctagaccttccgtcaaagaaactcttcagaagtctggtgttaggaaagagtttccaattactgaggcagtaggatctgataagacaaataggcatcccttagaatgcttacctggtttaattcaggataaggaatggaatgagaaggagttacagaaacttcattgtgcttttgcatctcttccaaagcacaaacctggtttctggtcagaggtagctgcggctgtaggttctcgatctcctgaagaatgccagaggaaatacatggaaaatcccagaggaaaaggatcccagaaacatgtcactaagaagaagccagccaattccaaaggccaaaatggcaagagaggtgatgctgatcagaaacaaactattaagataactgccaaagtgggaactcttaaaaggaagcaacagatgagggaatttctggaacagttgccaaaagatgaccatgatgattttttcagtacaacacctttacagcatcaaagaatactgttgccaagtttccaggacagtgaagatgatgatgatattctgccaaatatggacaaaaatccaacaactccatcatcagttatctttccattggtaaaaactcctcaatgtcagcatgtcagtcctggcatgctaggttctataaataggaatgactgtgataaatatgtttttcgtatgcaaaaatatcataaaagtaatggtggtattgtctggggcaacatcaagaaaaaattagttgaaactgatttctcaactccaacaccaagaaggaaaaccccatttaacacagacttaggagaaaactctggtattggaaaacttttcactaatgctgtggaatctttagatgaagaagagaaagattattatttttcgaactctgattctgcatagtaaaatgagaaaatatgattcctgggatttttaccataaagcagacagtgtttgtattttcaactggagtacatgtattttctttgtaaagtagcttcctatgaaaatgtggacttttttgaaggtttcatatgtttgtgttcaaagtaaaatatcctcattgctgcagcttactaaaaatgtaaagaaaattgtttttgctcgtgtagatatctgtaaatttgtttttgcatattaaaatatatatagataattttttaataagcatccaagtctgtttactttaagaaaaccatttcccaaacagatttttttttatttcaagaaaattttgctaccatttaagtaagagaaggtgagaaggatgacagaggttgtattggtagctattgaattcatgaaaacttttaagttagcatttgttagcagttattatccaagccagagtaggatttgttaccagttgttatccaaacctaatgtttaaattacacattgttgaaattaaattacacattgttgacatgcttctctcctgattgtttttattttaaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagtaaaaaaaaaaaaaaaa

SEQ ID NO: 107 - DNA, 2211 bp, Homo sapiens
tcctggcggagccatggctgcgcagcgggctggccgggggtctcctgaacccgggccccgccgccccgaccgcccggccccgccgccggggctgtccccgccgcgtccgtagcgcgtcctgccagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcttgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggtatgacccccgctgtaaacagtggatcaaggtggcctccatgaaccagcgccgtgtggatttctaccttgcctccatcgaagacatgctggtggccatcggcggccggaatgagaacggagcgctctcttcagtagagacgtacagtcccaagactgactcctggtcctatgtggccggcttgccaaggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattcttggtatttctatgatatcacagtaaccaattaaatactatctgtaactttaaaaaaaaaaaaaaaaaaaaaaaaaaaaaaaaaaaaaaaaaaa

SEQ ID NO: 108 - DNA, 3209 bp, Homo sapiens
attcccatcccccttctctagtccccgacctgcggcagccggagctcggggagcggagcgtggtggggaggggagcgggacaggcgacacaggagacagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatcaaaaaaaaaaaaaaaaaaaa

SEQ ID NO: 109 - DNA, 1936 bp, Homo sapiens
tcttcctttgggtccaaaggaacttttccccaccatgacattgctacctctgtggctgccgtttgtatttctctgccagtgagaacagatcacatagcccaggaaattcacagtgctgaatcacgagaccacagccagactgcagggaggactctgacatcaagctccccagacagcaaagtcacagaagagggcagagcacagaccctcttgccagggagaccttcatctggacaaagaatttcagattcggttccactggagtcaactgaaaaaactcatcttgaaataccagcttcaggaccaagttcagctagttcacaccacaaggaagggagacacaagacgttttttccttccagaggccagtatgggtgtggggaaatgactgtcccctgcccctctttaggaagtgacggtaggaaacgtcaggtatctggattaatcactcggaaagattctgtggttccttctaagccagagcagcccatagaaattcctgaagccccttctaaatccctcaagaagaggagtctggaaggaatgagaaagcaaactcgagtagagttcagtgacaccagcagcgacgatgaagaccgattagttatagaaatatgaagcttccagagaaacatggtgtctggtcaaaaagactgttgacgcttcacaagtaaatgttgtcaggctggcggaagaactaaactctatctgtgaaacacctacagattaggaaagccattttgagttatttacaagccaactccaaccaacttctgacccccaactcagccgcagcgttccccagctccccttgggagtgctctgctcatcttcaaatggtgccaggcagggcagacatggcaaggaagcaaactctgcaaatggtcaacgtgcacagtgactgggccttgactcccagcctcgtcttctgcacctgtcccccactgcctctctgcaatcaaatggcactaaccaagaaagccaccatcaacacatttctccacaagtggaccccacacagtcgaggcaactggctttctccattagtaaactgaggatttgcttccaaggtggagagcacacttgggataattggagtagcttgacaaagagacgggggtgtgaactgggcacaaagatacttctgttcattttggagacaaaattcagatacattaaaaaactgaagcttgttcagagtaattcacgtccttggtggagttgtaaatacacttcaaaatgcctatgatccggtgacatgctgattacttttaaatgttgcacaaatggtcaatgcttatttatggtcagatgatgcaagcacatgctcttgtgcctggtgcgtttgctgtggagatctctgagactgtcggtttttctagttcttgcaaaggaacggtgttaaaagttaatagaactgtctctctgtaatgagtcattttttgagagggaaaaattcacttattttcctctgattcttcttgtcatattgtgctctgagcaatttcaattagagggttacattttagtaatctgtacagcttcaactgatgcctgctcgtcgtgacgggagccttttagatttccttcagaagcttcaaggatacaaaactaattggagttttgacgctgttttacatctcggtaattttattttcggggcttagtgttactttgctgtcaaattaaatcagcctctgtattgtgcacgtcagaactgcacagagaaaattccccagtattccaagccggtgcgcccctgtgcagaagaaaacagatctacgtcagccagcccggggggcaaagcctcagttccactgccttcctctccctctccttccacgggagaggagaaacttaaagaggtttacattgctgcatttcaataaaattttatacttgcttttggtaaaaaaaaaaaaaaaaaaaaaaaaaa

SEQ ID NO: 110 - DNA, 3001 bp, Homo sapiens
gaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctgaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaacttcgcagaccctaaaaaaaaaaaaaaaaaaa

SEQ ID NO: 111 - DNA, 3338 bp, Homo sapiens
gcaggggccagacccggacggctccagagcctccagagcctccgggtctgggcggcgcttcggctcctcccgagccgcctgctagccccgcgccgcactccatccccacaggctggggacgggcccggtgcggctgtgtgggttcgggagcggagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacggtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagcctttcatccgctgtagtttacaatgcagggatctggttgatgaagcaaagaagtttcatctgaggcctgaacttcggagtcagatgcagggacccaggacaagggctcgcctaggagccaatgaagtgcttttggtggttgggggctttggaagccagcagtctcccattgatgtggtagagaaatatgaccccaagactcaggagtggagctttttgccaagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggagatatgatctatgtctctggaggctttgatggaagcaggcgtcacaccagtatggagcgctatgatccaaacattgaccagtggagcatgctgggggatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctggtgcaggagtagccctgctgaatgaccatatttatgtggtggggggatttgatggtacagcccacctttcttccgttgaagcatacaacattcgcactgattcctggacaactgtcaccagtatgaccactccacgatgctatgtaggggccacagtgcttcgggggagactctatgcaattgcaggatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagtatcaaaaatcctttccagaatgtctgtttctcactatgtgcaccgggtgattacaggcaccagtgcagtgatgattgtacttatttgacacatactccccgtcgtcctggttcttgttcctgagaagggtgggtaacagatattccaggaaaaagaatgcacattgaatggatgtgagagaccacattgcctctcccactgctttggggagcactttcctgtcatttctaacttaccacatgcttggtgtactatatgtacgttgtgcctcatatgttgcaaagaactaaggtgagtatagcctactagatatgggcaatatccagcctagatgattggaaagataccagtttaagtaaacttggtaaaatccaagtctttttttttttttccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatttcctttgtatttttttaagaaaatattaaaaatcaacggtctcaaatgccgagagtttgtggct

SEQ ID NO: 112 - DNA, 6830 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttatcgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggtggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtggaaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttacttttttttttttttttaaataaaagtcatttaatgtagaatacttttaatttcactttctgtattttaattttgttgaagggctgattgggatttccatgttcttattaaaaatctaacaaatctgaaaaaaaaaaaaaaaaa

SEQ ID NO: 113 - DNA, 1320 bp, Homo sapiens
gattatggagtttctgagcgagaagtttgccctcaagagccctccgagtaaaaacagtgacttttacatgggcgcaggaggtcctctggagcacgttatggagacgctggacaatgagtccttttacagcaaagcgtctgcaggcaaatgcgtgcaggccttcggacccctgccccgcgccgagcatcacgtgcgcttggagaggacctcgccctgtcaggacagcagcgtgaactatgggatcactaaagtagaaggacagccccttcacaccgaactgaatagagctatggacaactgtaacagtctccgaatgtctcccgtgaaagggatgcaagagaagggagagctggatgaacttggggataaatgtgatagcaatgtatccagcagtaagaaacggaggcaccgaaccaccttcaccagtttgcagctagaggagctggagaaagtctttcagaaaactcattacccggatgtgtatgtcagagaacagcttgctctgaggacagagctcactgaggccagggtccaggtttggtttcaaaatcgaagggccaaatggagaaaaagggaacgttatggccaaatacaacaagcgaaaagccattttgctgccacctatgatatatcagttttgccaaggactgacagctacccacagattcagaacaatttgtgggcaggaaatgcaagtggtggttctgtggttacttcatgcatgttaccacgtgacacttcctcctgtatgacaccttattctcactcgcctcggacagattccagttacacggggttttcaaaccaccagaaccagttcagccacgtgcccctcaacaattttttcactgactctcttcttactggggcaaccaatggacatgcatttgaaacaaagccagagtttgaaaggaggtcttccagtatcgcagttcttcgaatgaaagccaaggagcacaccgccaatatttcatgggccatgtaacatacagtactcttttatttttcttttaatagcaaagttaaacattcttatttctcatatttaaaggataccacaataagctgctgtgtgtggaattgctaaaggtcaagatattcagtgagaccagcttaaatgaatagttgttatttaacattaaaatctaagaatgaacctctgaaaagactaaataggtttaccatgtgccagtctccacaaaccctgttttagtagtaaggttttctttttctattgtacaagtcaatgaaatatgatcacgcaacttattaaagaataaatgtgttaaacaaaaaaaaaaaaaaaaaaaaaaaaaaaaa

SEQ ID NO: 114 - DNA, 3341 bp, Homo sapiens
tgagtttcacgcgcgtatgctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttagttgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattggcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatctaatttttgctgttcaaccatgttttttgatctagctctctgattccatacattccagacttctcagtggatttgtaataaactataaataaaaaaaaaaaaaaaa

SEQ ID NO: 115 - DNA, 3463 bp, Homo sapiens
tgaataaattattcggcatttagcttatcattctgaatttcactttttgctttttggtgctctgaaacttgcagagagaggtggagtgctaaggggagggtaggggttgtgatactttgcacacacatccctgtcattgttctgcctaaagagacagggctgggttcaaggccacatgtgctcctgtcatcctccacatttctgctccaagtgcaatccggagtgtcagctctccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaag

SEQ ID NO: 116 - DNA, 7737 bp, Homo sapiens
ggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcctt

SEQ ID NO: 117 - DNA, 4265 bp, Homo sapiens
agggcagaggacacccagttggtggccgggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacacatcgagaggacgggcctgcgacgctgccccacggccgttttcatggctgcttaaaatggtctatggtctgtctcttgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgc

SEQ ID NO: 118 - DNA, 2443 bp, Homo sapiens
gtgagggaacgcgctttcgaggcggaggttaggagcggggagcgcgcccgggtccagcgtcctgcttctccgcttcccgcgctgagctcttcgcctgtcgctgaggcgtcggtgccagctgcgtgaaggatggagagggcggggcgcgaatcctgagccagagactgagtgcttgggggtgggccgagcacttgggggccgctcttcggggcccgggtggtctggaacaatgttgcttggctgggcggctgcgggatagggcggaaggggacaggcttgaggcttggataggcgtgaggaggcgcatacgaccgcacaacccgaggtttgtaactgtattcggaagacgccgggtccggctgggactgccagaggaacctggctttgcaggactacggaggagtaacgtcgagtgaattggaagagggcccagggccgcacaagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataatccctgaaaaaaaaaaaaaaaaaaaaaa

SEQ ID NO: 119 - DNA, 356 bp, Homo sapiens
ctgccagagatgagtgcaggtgaggagagtagcagctcggactccgaccccgactccgcctcgccgcccagcactggacagaacccatcagtgtccgttcagaccagccaggactggaagcccacccgcagcctcatcgagcacgtatttgtcaccgacgtcactgccaacctcatcaccgtcacagtgaaggagtctcccaccagcgtcggcttcttcaacctgaggcattactgaagccccggcgccaccagctgcgcgtcttactccccttccctgcctatggtgtcgcttggctaagtgactcccagcccaagccccctcaagagtctgatcgtcgggggaggaggagtggg

SEQ ID NO: 120 - DNA, 1837 bp, Homo sapiens
cgctgaggagactccggtcactgtcctcgccccgcctcccccttccctccccttggggaccaccgggcgccacgccgcgaacgtaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattcctttatgcaaaaaaaaaaaaaaaaaaaaaaaaaaaa

SEQ ID NO: 121 - DNA, 2655 bp, Homo sapiens
agccggggcgggcgcgggcagcggcgggccggccgggctgtgcggggcgagcggcggcggcggcgggggcgcttcggccggggcggcagctgggcgccggcgggagctagcagcgtctgcagccgcgccggccgccagcgccccggcgcgctccggctcggccatggagctgccagctgttggcgagcacgtcttcgcggtggagagcatcgagaagaagcggatccgcaagggcagagtggagtatctggtgaaatggagaggctggtcgcccaaatataacacgtgggaaccggaggagaacatcctggaccccaggctgctgatcgccttccagaacagggaacggcaggagcagctgatgggatatcggaagagagggccgaagcccaaaccgctagtggtgcaggtgcctacctttgcccgtcgttccaatgtcctgaccggcctccaggactcctccactgacaaccgtgccaagctggatttgggcgcgcaggggaagggccaggggcatcagtacgagctcaacagcaagaagcaccaccagtaccagccgcacagcaaggagcgggcgggcaagcccccgccgccgggcaagagcggcaagtactactaccagctcaacagcaagaagcaccacccctaccagcccgaccccaaaatgtacgacctgcagtaccagggcggccacaaggaggcgcccagccccacctgcccggacctgggggccaagagccacccgcccgacaagtgggcgcaaggtgcgggggccaaaggctacctgggggcggtgaagcccctggccggtgcggcgggtgctccaggcaaaggctccgagaagggcccccccaacggaatgatgccggcccccaaagaggctgtgacgggcaacgggattgggggcaagatgaagatagtcaagaacaagaacaagaacggacgcatcgtgatcgtgatgagcaaatacatggagaacggcatgcaggcggtgaagatcaagtccggcgaggtggcagagggggaggctcgctcccccagccacaagaagcgggcagccgacgagcgccaccctcctgccgacaggacttttaaaaaggcggcgggcgcagaggagaagaaggtggaggcgccgcccaagaggagggaggaggaggtgtccggggttagcgatccgcagccccaggatgccggctcccgcaagctgtccccgaccaaggaggcctttggagagcagcccctgcagctcaccaccaagcccgacctgcttgcctgggacccggcccggaacacgcacccgccctcacaccacccgcacccgcacccccatcaccaccaccaccaccaccaccaccaccaccacgccgtcggcctgaatctctcccacgtgcgcaagcgctgcctctccgagacccacggcgagcgcgagccctgcaagaagcggctgactgcgcgcagcatcagcacccccacctgcctggggggcagcccagccgctgagcgcccggccgacctgccaccagccgccgccctcccgcagcccgaggtcatcctgctagactcagacctggatgaacccatagacttgcgctgcgtcaagacgcgcagcgaggccggggagccgcccagctccctccaggtgaagcccgagacaccggcgtcggcggcggtggcggtggcggcggcagcggcacccaccacgacggcggagaagcctccagccgaggcccaggacgaacctgcagagtcgctgagcgagttcaagcccttctttgggaatataattatcaccgacgtcaccgcgaactgcctcaccgttactttcaaggagtacgtgacggtgtagccggagggcgtcggaaggggaagcgccattcccgcgggggggcggggagctgagcacctggggcctcggggcgggctcccctctcgccaacccgccaaccgcgagagacccaggctggcccccagggtgaggacgcccggagcggaggtaaccatgttccccctgcggcggctgtcagacctgggcggaggccccttccacgcggtgccggcggggctcgccctctcctgcccttccccgctggagatggacccccggaacggacagggcagctctgcgcccggcctcagagttctagtattatattttaaccgtgctaacttgtcaagtgctgactctactcccgtttgtacgtggtgttattattgaaatgtattgtttgagctcaaaaggcccgaccaccccccttcgggctgctatatatatatttatttgtaggtatttatatattgaaatataaaaacctagatttatggagtttcctctagatcatgttatattctatatcagacaaactattttcttttgacctttcttcccctccatccagtatttcggttgatttcattttctcccctctcttccccttccacgaactgcaataccagtaaccttggtatatattttttgatactgtacacatggatgtcttgtttctatgtgcaaaaaaaaaaaaaaaaaaaagtttgttaaaaggctacacgagctctctagaaactgctgctactagaaatgtctaaactataagcttccaactattacctgcttgaatgtaaatattaaatggagatgttgaaggtgcaaaaaaa

SEQ ID NO: 122 - DNA, 11571 bp, Homo sapiens
gaaggatccgttttggcgggcggttggcgttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgaggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggttatccttgtttttcttcgcggtttgccatgtgtgaaagtagatttcctgctattgatatattctcattatagacagaatagtggagaacagtgttgccatggacaaaatccagttttggtccactctggggagcatttggacctgtggtgcttctaacaattaaaagtctagatggtccttgactgtcccccagccatactgcatactactttgtgcattctactttgtgtcattaatgaaagattggttctgtccctgtaacttaggcatttattattcttaactcttcattcctgttctgtagccacccagcagtccattttccctatgttcaggccaaaccacagggcattggggaaggtttttgggattttcttattgagattttgttgaatctgtagtttaccccagctttcctaaggtacagtgaggggttggagggatctgtgtttggcccggggagcaattgtctctaccttaaggttcagttttgagggcataaaatactactttgcaatgtcatgagaacaccgttagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctttttttttgagacggagtcttgctctgtctcccaggctggagtgcagtggcgcaatctcggctcactgcaagctccacctcccgggttcacgccattctcctgcctcagcctcccgaggagctgggactacaggcgccggccaccacgcccggctaattttttgtatttttagtagagacggggtttcaccttgttagccaggatggtctcaatctcctgacctcatgatccacccacctcggcctcccagagtgctgggattacaggcgtgagccaccgccgggccgagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgtgaagttttttagatagtttcataaaaacaattctggtttctttttgcttgtgctgactttcttggattttaatctacctcatcttgtctttttagagttacttcaacttgtcactttaacattgtgcttgactttggttgttttctaagatggaatttttcctgttcattgacagcttgttctcttgccttttcattctgatcctcatttcatctaacatcatctcatattgctcctctgtcaagagaaatgttttaaaatagtttaaagtcttgttttatgggaagaaagtgatcctccaatgctatttgtttctgaggtcagtaagagaaggagttaaaacaaggcagtggggaagggaatgaatcctgcactggaggcaaaagctgacaaggaaagagccattaattaagacaatttcaaagtcaactgattgtgatcattaatgtcacaatagatcaaaacctaattatcacagcctaggtaagagccatcagtattaatcggaaaatctaataggaaactattatcaagaaattaggccaaattgaatgcagtgaactttttatcttggcattctctatttttttgtgatgtcccctggcattggcaggtgtgaccctaacagtcgattcaaggccaagtggtcagtttgtcagccttttttaagggatttctttttatttttaggaattccaaacagagttaacctaaactgtcattgccaaaagatcagtcttaaactttcttagcacctgtacctgtttaatgtgatcagctatcagtgaggaaaaaaaaaaaaatctatttaggtcttggaatggttcctgtacctagagtatccatattgaaccttttttttttttttttttttttttttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggatgctactgcgtatttctctctgcaggttggggattaaagttcctttccccatgggtttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgcttttcaaaaaaaaaaaaaaaaaaaaaaa

SEQ ID NO: 123 - DNA, 3284 bp, Homo sapiens
gagcggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctcccggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaaaaaaaaaaaaa

SEQ ID NO: 124 - DNA, 3964 bp, Homo sapiens
ccagccccagcatcgcgcgccgcagccgcggccccgcagctccgcccccggcccggcccggccccgggcccgctcgcccgccgccccgcatggagctgtcagccatcggcgagcaggtgttcgccgtggagagcatccggaagaagcgcgtgcggaagggtaaagtcgagtatctggtgaagtggaaaggatggcccccaaagtacagcacgtgggagccagaagagcacatcttggacccccgcctcgtcatggcctacgaggagaaggaggagagagaccgagcatcggggtataggaagagaggtccgaaacccaagcggcttctgctgcagcggctgtacagcatggacctgcggagctcccacaaggccaagggcaaggagaagctctgcttctccctgacgtgcccactcggcagcgggagccctgagggggtggtcaaggcgggggcacctgagctggtggacaagggccccttggtgcccaccctgcccttcccgctccgcaagccccgaaaggcccacaagtacctgcggctctcgcgcaagaagttcccgccccgcgggcccaacctggagagccacagccatcgacgggagctcttcctgcaggagccaccggccccagacgtcctgcaggcggctggcgagtgggagcctgctgcgcagccccctgaagaggaggcagatgccgacctggccgaggggccccctccctggacacctgcgctcccctcaagtgaggtgaccgtgaccgacatcaccgccaactccatcaccgtcaccttccgcgaggcccaggcagctgagggcttcttccgagaccgcagtgggaagttctgaatcaccgtttttactcttcttaaactgttttcttttgggcttggggtgggacttccagagatagggatgggttgggggcggggtaattattttatttaaaaaaataccgagcagcaaaaggggagaagatcccactactctcccaccacctgccctttctctgagggacgtttaccacgaggcctcaggctggggatggagagagttgctctgggagttggggtaccacccccagggcaggatggggacaggatcacctgcccgggacaccaccattatcattctcctctagtgacgcagcagctggttctgggagttaaaggagcattggaaggcccaaaccctctcccttgagtggccaccccagcctggttggctggttttccccttttctcttgtttcaattgggtctttaccttgaactctcctctctggctttgcggtgggctgtggaggctggttttgaccaaaagtgagtggggcgggaggaaggggcaggaggaagggttgaggttacttggggcgagtcccttccccttcagagaggcttctatccttcccagggaggaggcgccgctgagacccttctgctgagagctctgccctcccctcatcacctggcctgtgcagaaacgctcatgcacacctggctgcacaggtgtgcacgcattacccttcgcgtgtacgttcccatgtgccccgtgaaagcatgtgtggctgcagacgtgtccacatgggccttgcgaacctgggttagaaaccctggccaggcgaacgtggggtgattcacagcacaaaagacctcaccaccacacctgcactcaccccaccttgcatgcaccttgctacctgcttgcggctttcagtggagggcaggggtctggcacaggtgcgatggcaccccatgctccaggcatacagatgtggtttctcggctgcaccgggccaggctgcgggtgtgcaggcgtctgctaagttgtgtgatgtatcagcacaggctttgagacgtctggaccctgtccttcctcccgtgaggggttcttgttctttctgactcaggtgacttttcagcccttccaattcccctctttttctgccctcccctccaactcagccaacccaggtgtgggcagtcagggagggagggagtgtcccaccacgttctcagggcagcccttgactcctaagccccttcctccttccattctgcatcccctccccatccaacctaaatgccacagctggggctgagctgtattcctgtggagggacctctgccgtgcctctctgaggtcaggctgtgctgtgtgatgggcaggctttgccccagcccacccctggcaaggtgcacttgttttctggtttgtacaaggtgtcctgggggcccgtggcttccctgccagtgaggagtgacttctccctctcttccagtcctgtaggggagacaaaaccagattggggggcccaaggggagcatggaaaaggccggctcccctgtctttccttggctgtcagagtcagggtaacacacaccaagagtggagtgcggccagcaagtttgagacctgcccgccctcctcgcagctctgctctgtgtcctcaggaagtcacagagtctactgaggcaaggagagggtgattctttccccaaatcccttcttccctggttcccaaaccaaagacagcctgcagccctttctgcatggggtgctctgttgacaggcttcccagatccctgagtctctctttccttcctcctcgatctttagttgtccacggtcaattcagtgcttccattgggggacagtcccctccgggatgacctgattcacctccagcccagggaatggaatctagaggaatacgtggggtgggtctggacaaggagcggcaggaatcaccacccatctccagctgtggagccctgtggaggggaaggggaagcttggggttcagaggggactcttccaggagaggggtgcccagcggaggtaaagatgatagagggttgtggggggtctctagttgaatgttttggcccatgactttggaacatggctggcagcttccagcagaagtcacgctccccatcccccaggggacataggacctttttcctgcttcctggtcactttcaaagaactatttgcgcaatctgtgggtctgtggattcacggggctttctgtgtgggtgctgcagttgcttttgtctgcagcagcaggacacatctttcctcttactcagccctttatggcccatggggaactccgtggctcagggagagctgaactccaggggtgtgacctgggacgggtgggcctgaggtgcccagctcagggcagccaggtggctcatgggctgtagtgagccagctccctgggggaaaaggctgtgggccgttaggaccatcctccaggacaggtgacctctatgaggtcacctacggctgtggccgtgcaggcctccttccagcccagagtggcccagtagagcaaggcagacagtgacctccacccccgcagccctcttaaaaggccagtactcttgggggtggggggagggtttagaaagcatttgcccatctgcctttctttcccccagcccccacccgctttgaatgtagagacccgtgggcacttttccttttgtggtggggggtgcggaggaggtacccccacccctggcacagccgcctggaatgcaggactgtcactgctgttcgggtgatgacctcgttgccaagctcctcctgtccccttgttctgggggcaggcgctgtgcttctgtgaggtggtttagcttttgctttcgaagtggccagctgcggccaccaggtctcagcacaagagcgcttcctttgcacagaatgagcttcgagctttgttcagactaaatgaatgtatctgggaggggtcgggggcacgagttgattccaagcacatgcctttgctgagtgtgtgtgtgctgggagagtcagagtggatgtagagcgcggttttatttttgtactgacattggtaagagactgtatagcatctatttatttagatgatttatctggtaaatgaggcaaaaaaattattaaaaatacattaaagatgatttaaaaaaaagaaaa

SEQ ID NO: 125 - DNA, 1772 bp, Homo sapiens
aggacagccgagttcaggtgagcggttgctcgtcgtcggggcggccggcagcggcggctccagggcccagcatgcgcgggggaccccgcggccaccatgtatgtgggctatgtgctggacaaggattcgcccgtgtaccccggcccagccaggccagccagcctcggcctgggcccgcaagcctacggccccccggccccgcccccggcgcccccgcagtaccccgacttctccagctactctcacgtggagccggcccccgcgcccccgacggcctggggggcgcccttccctgcgcccaaggacgactgggccgccgcctacggcccgggccccgcggcccctgccgccagcccagcttcgctggcattcgggccccctccagactttagcccggtgccggcgccccctgggcccggcccgggcctcctggcgcagcccctcgggggcccgggcacaccgtcctcgcccggagcgcagaggccgacgccctacgagtggatgcggcgcagcgtggcggccggaggcggcggtggcagcggtaagactcggaccaaggacaagtaccgcgtggtctacaccgaccaccaacgcctggagctggagaaggagtttcattacagccgttacatcacaatccggcggaaatcagagctggctgccaatctggggctcactgaacggcaggtgaagatctggttccaaaaccggcgggcaaaggagcgcaaagtgaacaagaagaaacagcagcagcaacagcccccacagccgccgatggcccacgacatcacggccaccccagccgggccatccctggggggcctgtgtcccagcaacaccagcctcctggccacctcctctccaatgcctgtgaaagaggagtttctgccatagccccatgcccagcctgtgcgccgggggacctggggactcgggtgctgggagtgtggctcctgtgggcccaggaggtctggtccgagtctcagccctgaccttctgggacatggtggacagtcacctatccaccctctgcatccccttggcccatctgtgcagtaagcctgttggataaagaccttccagctcctgtgttctagacctctgggggataagggagtccagggtggatgatctcaatctcccgtgggcatctcaagccccaaatggttgggggaggggcctagacaaggctccaggccccacctcctcctccatacgttcagaggtgcagctggaggctgctgtggggaccacactgatcctggagaaaagggatggagctgaaaaagatggaatgcttgcagagcatgacctgaggagggaggaacgtggtcaactcacacctgcctcttcctgcagcctcacttctacctgcccccatcataagggcactgagcccttcccaggctggatactaagcacaaagcccatagcactgggctctgatggctgctccactgggttacagaatcacagccctcatgatcattctcagtgagggctctggattgagagggaggccctgggaggagagaagggggcagagtcttccctaccaggtttctacacccccgccaggctgcccatcagggcccagggagcccccagaggactttattcggaccaagcagagctcacagctggacaggtgttgtatatagagtggaatctcttggatgcagcttcaagaataaatttttcttctcttttcaaaaatgtataaaaatcattatacatagcattaaagaaacatttttgagaagtacaaatca

SEQ ID NO: 126 - DNA, 2090 bp, Homo sapiens
gggaccgcctcggaggcagaagagccgcgaggagccagcggagcaccgcgggctggggcgcagccacccgccgctcctcgagtcccctcgcccctttcccttcgtgccccccggcagcctccagcgtcggtccccaggcagcatggtgaggtctgctcccggaccctcgccaccatgtacgtgagctacctcctggacaaggacgtgagcatgtaccctagctccgtgcgccactctggcggcctcaacctggcgccgcagaacttcgtcagccccccgcagtacccggactacggcggttaccacgtggcggccgcagctgcagcggcagcgaacttggacagcgcgcagtccccggggccatcctggccggcagcgtatggcgccccactccgggaggactggaatggctacgcgcccggaggcgccgcggccgccgccaacgccgtggctcacggcctcaacggtggctccccggccgcagccatgggctacagcagccccgcagactaccatccgcaccaccacccgcatcaccacccgcaccacccggccgccgcgccttcctgcgcttctgggctgctgcaaacgctcaaccccggccctcctgggcccgccgccaccgctgccgccgagcagctgtctcccggcggccagcggcggaacctgtgcgagtggatgcggaagccggcgcagcagtccctcggcagccaagtgaaaaccaggacgaaagacaaatatcgagtggtgtacacggaccaccagcggctggagctggagaaggagtttcactacagtcgctacatcaccatccggaggaaagccgagctagccgccacgctggggctctctgagaggcaggttaaaatctggtttcagaaccgcagagcaaaggagaggaaaatcaacaagaagaagttgcagcagcaacagcagcagcagccaccacagccgcctccgccgccaccacagcctccccagcctcagccaggtcctctgagaagtgtcccagagcccttgagtccggtgtcttccctgcaagcctcagtgcctggctctgtccctggggttctggggccaactgggggggtgctaaaccccaccgtcacccagtgacccaccgggttctgcagcggcagagcaattccaggctgagccatgaggagcgtggactctgctagactcctcaggagagacccctcccctcccacccacagccatagacctacagacctggctctcagaggaaaaatgggagccaggagtaagacaagtgggatttggggcctcaagaaatatactctcccagatttttactttttcccatctggctttttctgccactgaggagacagaaagcctccgctgggcttcattccggactggcagaagcattgcctggactgaccacaccaaccaggccttcatcctcctccccagctcttctcttcctagatctgcaggctgcacctctggctagagccgaggggagagagggactcaagggaaaggcaagcttgaggccaagatggctgctgcctgctcatggccctcggaggtccagctgggcctcctgcctccgggcaggcaaggtttacactgcggaagccaaaggcagctaagatagaaagctggactgaccaaagactgcagaacccccaggtggcctgcgtcttttttctcttcccttcccagaccaggaaaggcttggctggtgtatgcacagggtgtggtatgagggggtggttattggactccaggcctgaccagggggcccgaacagggacttgtttagagagcctgtcaccagagcttctctgggctgaatgtatgtcagtgctataaatgccagagccaacctggacttcctgtcattttcacaatcttggggctgatgaagaagggggtggggggagtttgtgttgttgttgctgctgtttgggttgttggtctgtgtaacatccaagccagagtttttaaagccttctggatccatggggggagaagtgatatggtgaagggaagtggggagtatttgaacacagttgaattttttctaaaaagaaaaagagataaatgagctttccaga

SEQ ID NO: 127 - DNA, 855 bp, Homo sapiens
atgtacggaagctgtcttttggagaaagaagcaggcatgtacccgggcactctcatgagccctgggggcgacggcacagctgggacaggcggcacagggggcggtgggagtccgatgccagcctccaatttcgctgcggcaccggctttctcgcactatatggggtatcctcatatgcccagcatggatcctcactggccgtctctgggagtctggggctcaccctacagtcccccgcgagaagactggagcgtgtatcctgggccgtctagtacaatgggcacagtgccggtgaacgacgtgacctctagccccgccgctttctgctcgaccgactacagcaacttgggccctgtgggcggtggaactagcggcagcagcctaccaggccaggctggcgggtcgcttgtcccgacggacgcaggcgccgccaaggccagttcccccagcaggagccgccacagcccctatgcatggatgcgcaagacggtgcaggtgacggggaaaaccaggacaaaagaaaagtatcgtgtagtttacactgatcatcaaagattggagctggaaaaggaattccattgcaatagatatatcaccatccagagaaaatcagagctggcagttaacctgggcctttccgagagacaggtgaaaatctggtttcagaatcgcagagccaaggagagaaagatgatcaaaaagaaaatctcccagtttgagaatagtggaggctcggtgcaaagtgactctgactccatcagccctggggaactacctaacacttttttcaccacaccatctgctgttcgtggatttcaacctattgagatacagcaggttatagtctccgaatga

SEQ ID NO: 128 - DNA, 2591 bp, Homo sapiens
cggaggtgcgcgggcgcgggcgagcagggtctccgggtgggcggcggcgacgccccgcgcaggctggaggccgccgaggctcgccatgccgggagaactctaactcccccatggagtcggccgacttctacgaggcggagccgcggcccccgatgagcagccacctgcagagccccccgcacgcgcccagcagcgccgccttcggctttccccggggcgcgggccccgcgcagcctcccgccccacctgccgccccggagccgctgggcggcatctgcgagcacgagacgtccatcgacatcagcgcctacatcgacccggccgccttcaacgacgagttcctggccgacctgttccagcacagccggcagcaggagaaggccaaggcggccgtgggccccacgggcggcggcggcggcggcgactttgactacccgggcgcgcccgcgggccccggcggcgccgtcatgcccgggggagcgcacgggcccccgcccggctacggctgcgcggccgccggctacctggacggcaggctggagcccctgtacgagcgcgtcggggcgccggcgctgcggccgctggtgatcaagcaggagccccgcgaggaggatgaagccaagcagctggcgctggccggcctcttcccttaccagccgccgccgccgccgccgccctcgcacccgcacccgcacccgccgcccgcgcacctggccgccccgcacctgcagttccagatcgcgcactgcggccagaccaccatgcacctgcagcccggtcaccccacgccgccgcccacgcccgtgcccagcccgcaccccgcgcccgcgctcggtgccgccggcctgccgggccctggcagcgcgctcaaggggctgggcgccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttgtgccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaa

SEQ ID NO: 129 - DNA, 1837 bp, Homo sapiens
gagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatggttacaaagcc

SEQ ID NO: 130 - DNA, 1269 bp, Homo sapiens
aggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgaaaaaaaaaaaaaaaaaa

SEQ ID NO: 131 - DNA, 1250 bp, Homo sapiens
gagagaggccacacaggagtgggtgacagaggagactgcagagggcaggtctagggcagaagatcgagagagggcaggcccaggtcaggaggaggtagagagagggcagccggagcaccccaaggggtgcctcaagagcaggtgggggcggggagccgagggggcgggccggccatgtcccacgggacctactacgagtgtgagccccggggtggccagcagccactcgagttctcagggggccgagctgggcccggggagctaggggacatgtgtgagcatgaggcctccattgacctctccgcctacatcgagtctggggaagagcagcttctctccgatctctttgccgtgaagccagcgcctgaggccagaggcctcaagggccccggaacccctgccttcccccactacttgccgcctgaccctcggccctttgcctaccctccacataccttcggcccagacaggaaggcgctggggcctggcatctacagcagcccagggagctacgaccccagggctgtggcggtgaaggaggagccccgggggccagagggcagccgagctgccagccgaggcagctacaatcccctgcagtaccaagtggcacactgtgggcagacagccatgcacctgcccccaactctggcagcacccggccagcctctgcgcgttctcaaggcccctttggccactgccgcacccccctgcagtcccctcctgaaggcgccctccccggctggccccttacacaagggcaagaaggcagtgaacaaagatagccttgagtaccggctgaggcgggagcgcaacaacatcgccgtgcgcaagagccgagacaaggccaagaggcgcattctggagacgcagcagaaggtgctggagtacatggcagagaacgagcgcctccgcagccgcgtggagcagctcacccaggagctagacaccctccgcaacctcttccgccagattcctgaggcggccaacctcatcaagggcgtggggggttgcagctgaggctggctggtggattgtgggcaccaggctccctggcacggcctaactctgcggacccccatcctgctgggggcctagaaccctgagacatagaccatggataaatggcaaccggggtggcaaagagggcaggacccagcataatgattatatggctgaataaagttgcactgtgactgggaaaaaaaaaaaaaaaaaaaaaaaaaaaaaaaaaaaaaaaaaaaaaaaaa

SEQ ID NO: 132 - DNA, 3750 bp, Homo sapiens
ggcggcgcgcgcggccccggcgagcaggggaagccggtggccgcggctgcggaacgggcggaggctgccggtttcgtaaccgtcgctcctcctcgctgactcgcgggctgtgaggcctgggtcggctcgggccgcaccgcgcggggccgctcggagtggaggccgcctgggggcaggcgggctagaggagcaggtacatgtgaagattttttggcagcttagcgtggaaaccattgatcaccctgctctcatttctacctgttctgtgttggcaagggagagtgcccaaatgagcaagatatcgcagcaaaacagcactccaggggtgaacggaattagtgttatccatacccaggcacatgccagcggcttacagcaggttcctcagctggtgcctgctggccctgggggaggaggcaaagctgtggctcccagcaagcagagcaaaaagagttcgcccatggatcgaaacagtgacgagtatcggcaacgccgagagaggaacaacatggctgtgaaaaagagccggttgaaaagcaagcagaaagcacaagacacactgcagagagtcaatcagctcaaagaagagaatgaacggttggaagcaaaaatcaaattgctgaccaaggaattaagtgtactcaaagatttgtttcttgagcatgcacacaaccttgcagacaacgtacagtccattagcactgaaaatacgacagcagatggcgacaatgcaggacagtagacctcaccctttccagactttagagcttgtggcttgaatgttaaaggtgtgaccaccgacaccactcatgtcaatggctgaaagttgtccatttccatgactcaaagacccattggaggctattttctgggatcagcactgaagagttgattagctaaaaatgttagccttgtaattcgaatatctggttttaaatgatagaggtttttgtgggaatcaaaatcccccaaatgttaaggtatatggtaaaaaaagaaatatctgggatcccgatgttcttaataaatcctgacttcccaagaaatgcttcttttttaagttgacaaaaggaatggggaactggcaggccgcgcagaaggttcttggttttaatggataggctgaattggattaagaaaagttgaatgccacctatggtaatctatttgtgattttcttctaaattatgtattataaattcgtagagctatagaaagcaatgagtgtgtaatttggagtgattttatatatggcataaactttgttttaacataattagtactgttttcccccaaaagtacaagtttttgagtagcaatgtcaggttaagtaaagaaacttcatcacatcttataggtagtgtgtggccaattgacttaaaaaatacaaataacatttaggaagcaaatagattaaacacaaaaataaaactaaagcataggaattatgtttttgagatacctttgggcttagattggcattgttttattctaaaaacccaactcagtggtgtagagaaacttgtgtaccaaaattttagtttctgcagatgctagtgtttttttggatacaattttgacaaccaagttagtaaacaaaatatcttaacagtttgatgacacaagctactgatgagggtttggaatattaattcagaaggtagtttctcttgtgttcaaaatagctgccatggggctgttacttttaaagtcaaaattttcttctgaaggctcattttggtatttgatcttaaccaagtgattattagagaaatgtatcaactccatgccatctcccaaaataattgtctaagaaaacttgaaagtgtaaggttttaacctttaatttatttctcttaaatacatcttttgatattgttgttgtgacatttctttttctggttagtgggctttccagactttgtaccactgcttctgtttattcatttatatgcttttgtgtcccataaattatttcagaaaatgctgataaaactcaggatattgacatttttgttgagactaaaaaatggcagtcgctaaagtagggactctagagtctggcttacgtcagtgttggtagtttagattgtctttgtcaacgttttttcttctctcttttgctttcttttctttctctttttttcttagcacagttctagctcaaatttgtgtattttttgtgtgcctgggctggagatgagagactgagtcataactgatttaaaagtttgtgttatcaggtatcttatttgaacatggtcatttttggccacattgctgtttcatactaggacttgggatgatgtagccagaataaaactcaagttgcaccctccggttggtggaagattgctgaccgtgccgtttctgggcaggagaagacatcatggtgtccagcaactcagcaaagccattcttaagagtcgtgaggtccttctgaatgtaaaactggagcccaggagaagctgtcccaggagggctgttaactccctatagagccaggagacaggataggggtttctagggtccaacaccagcttaccttggagtatgaatctacccatgaaggatgagagatgttttgaaaaactagccaggacacacccacaggatcctactggctccttagcagctgattggtgttacataattaacttaattggagatgcattaggtcacttgaatgtataagcaagcacctatggtaggcgctacagacatttaaatctcttgggaattcgatgctcccatggaatttataccagttatatgaattgacttaagtatcttgaaaaagaaactttagagaaagcatcaggggtgtgtactcagtatttcaaatcagaacacaagattggaacttttggaaaaatgggttcaagctttcctattagccatggaaatgcaaagtttagcagaagcaagcaattaggcagagaacaaaaatgttaagcatggtgttgtctatcttattgaagtggttggaaatgaaagcttttaatttgatagatttatcagtataaaattagggaaaccacgtgtggggaatgaatcaatttagagcttcgggaattgtgaggtgacttttgtaacttttgttctgtgtgtgacctgtgaaccactaggatgtgatctgcccttgtgggcaggtccagcatagttaggagttaggctttagcataaatttctagctgcatctgagtctcctgggatgggtgctctttggctggttttggctgcggatggtgagatcagagcagctcttcctgctgctggcccctgcaatcagttgttgggatgccagtgcagatcactaagtagtaagattttaatcaaacacgaccaggtccgaaatgcaggtcatgagtgtgaaattctcaaatttacataaaaagtagaagtatagacagtttaacatttggtattaaaggagaggaaattgtagcagcttttcacgtttcccagtccccattagagggcttgagaccttgtacctgaacaacccattttgcactcagtgctttctgatgccttaggagaattgttttgtttcacaaaagctgggaaggaagaagtccattctgcagctgttagatctgcctctcaggaaaaagtactaacttgttctttttgttcctggctttcatcagtttgtgagatttctctattttttttaaatataattttatttctttcaacaaatataaaataaaaaacaactttggaacaatgaaaaaaaaaaaaaaa

SEQ ID NO: 133 - DNA, 5043 bp, Homo sapiens
ctctccctgccgcccggcccggctcgcccagtccagtggctccagtccggatctcgccgccgcccggcccaggtgcgagtccccactgctggggaggcggcgggccccggctcccctcggccgcctagcccgcctcgcccgcccggggttggcggggagggaacagctgggcggccccagagcccctcggaggacaatgcgcccggcgctcggccaccctcgctcggtctcctccgcgtccggttccttcccgccgcccccggcagccgcccggctgcagcccctcttcctccgcgggggctccttccgcggccggagaggctccggcgacagcagcaccagcaccagcaccagccgcgggggaggcggcggcagacgcggcgggggcggcggctccccgagcagcagcacgggcgccgagcgcgaggacgacgacgagagcctcagcgtcagcaagccgctggtgcccaacgccgcgctcctggggccgccggctcaggtgggcgcccccgccggccccgcgcctgtcgccttctcctcctcagcggccacctcctcctccacctccacgcccacctcctcctgcagcatgacagccgcggacttcggcgggggcgccgcggccggggccgtcgggggccccgggagccgctcggcggggggcgcgggcggcaccgggaccggcagcggcgcctcctgctgcccgtgttgctgctgctgcggctgcccagaccgccccggccgcagaggtcggcgccgcggctgcgcccccagtcccaggtgccgctggggctaccaggcgctgtccgtggtgctgctgctggcgcagggcggcctgctggacctgtacctcatcgccgtcaccgacctgtactggtgctcctggatcgccactgacctggtggtggtggtgggctgggccatcttcttcgccaagaacagccggggccgtcggggcggcgcagccagcggcgcgcacaaccaccacctgcaccaccaccacgccgcgccgcccctgcatctgcccgccccctcggccgctaccgctggggccaaggcacgcggagcccgcgggggcgccggcggcgcggggggcggcctgggggcggccgcggcagcgggcgagttcgccttcgcctacctggcctggcttatctactccatcgccttcactcccaaggtggtgctgatcctgggcacgtccatcctagacctcatcgagctacgcgcgcccttcggcaccacgggcttccgtctcaccatggcgctgtcggtgcccctgctctacagcttggtgcgggccatcagcgaggcgggcgcgcccccgggatcggcaggacccctgctgctgcagccccagcggcaccgcgcggccggatgcttcctgggcacgtgcttggacctgctcgacagcttcacgctggtggagctgatgctggagggccgcgtgccgctgcccgcgcacctgcgctacctgcttatcgccgtctacttcctcaccctcgcctcgccggtgctctggctctacgagctcaacgccgcggccgcagcggctgcatcctggggccaggcctccgggcctggcagctgcagccgccttctgcgcctgctgggcggctgcctggtggacgtgcccttgctggcgctgcgctgcctcctggtggtcagctaccagcagcccctctccatcttcatgctcaagaacctcttcttcctcggctgccggggcctggaggccctggagggctgctgggaccggggcaatcgggcctccccgagtcgggccagagggggctacggtgctccgccctccgcccctccaccacctccgccaccacctcagggaggctcccagctgggccactgcatctcggagaacgaggggggtgctcatggctatgtcaacaccctggctgtggcctctcagaattgagggtgaagggcacgggtccttgtttttgggttgagagtccccaacccccttgtcttctaccttctgtcacctagatttgatcagggtctatttggaagaggtaacccttttcagggctaagggccagggtgttcttctgcaccctggggtgaggacggcttggagggagaccagcagttaacggtgagggaggtaggtgcacttaccctctcctctcttctcctatcctaccccaatcctgacctccaaggggctggtacctctgcttcttgctttgcccacctccactctaattcccatccattaggaggagaggggtgctgggccttggaccttctcccttgcttagaagtgccagcctcttttaggctgtggttagtggccattgtcccatgccttgaaattgacccagaacccactttccactgatgtgtctcttggatttcttccaggtgatagatacaaagtgtatgtctctgtgtgtgtagtgttgttttctcgtgtccaccctgtggccctttgcaatgggtaggagatctggggaggccctgccccctacaccatacttatcaccaccctcctcttttctgcctggatttgtgaccatgaattcccaggaagagctgggcccctgggagctgcccaggtactccccttgaagggagaatctcacccaggatcttcctcaatactgctcctctcttctcagctcagggagaggaggggatccattctctaaggaccaaactgcaccctttcttgggtgagtgagcatttctacctccgtgctttcaacttttgttgcatcatgcactgatgctgcttgcaaaaaatgaagacaaaatactcagaagttgcatttgccatggccactggctccagctggggtttggtgccagtgttattacagggtctgcggagtatcagccattggcttggcctctctctgttcctccctctgcacctagaactcttatccttcctgtggtttggtgccgactgggtcggatctgggcttagagtaatagctttggtgggtttcctggatggatgtgaagttgggcctcccatgggcccaagggagtaggaagccccattccccacctgtccttcctctaggaagtgtagatcagaaagtgaggtggtgacctcccacctctggtctggttaagagtctcactagggccaaggcaggctgcagaactttccctcttcctctcattgagggtgatgacaagagacatccggggactgtgcacttacagtcggtgtggaatgtcactcttgcagtctttgaggcaggataagtatttttacatattttaagggtgcaggaggacagcagctaacaaggccaggaaatactcacttccctccaccctcaacaggatgtggtgggggtgaaacttgaagaatttttgtttccccttctcccttcttacgtttgggaagttttatgtagtgtaacaaactctagacgagttaccagaagatgtggattctagttctgattctgtcactcattggctttgagtgacatatttttatttcctgggcctgttttctcacattaaaaaagtagaagttagatgagtgatctctaaggttgaaggtaatttcagctctcacattcttttgagtttgtggctcttgaaagccctggtcctgatgctccctgtaaaggtggctgggagagaagccagccaggctgcacttgcagaacattccctgctctgtactgggtgtgtgaagccccagcagagaaggccggagggagggcttgggtgcctgggctgggtgtggggcagggcctggcacagctgcagagtgcacagggagggtcagaagtgccaagtcactggccgttaactcagcacccaggccaagcccccgcctcccacttgaagccccctcttacaactgttttgggggcttggagcagaagacacccttgtagacagacataagaggggcagaaggcttgaccagagttctcttgagcctcctcatgctctcagagcagggaacagcgggggaaaatgtttacactccatgcacaatctgtgcttccagtccctcaccctatgtggcccaatagctggctggatttcacacttaattggtatttttttctgccttcttcccctgcccccactgactcctctcctctccctttgattgtactcaaggttctggggcctgggccctgggtgggtaccaacagctgctcgctgttcccatgtcctctctccagctttgctgtgtttctctgctacctaatctcagtgactgtgaaaggacattgtgtctgagccatggccagccgctggctggccccctgatctgccccccttctattgtttggatggccatctcctgctgggcctccctgactgtaaaatctctgtactgtttgttaggtttttggtgggaggctgtgataagttccaatgagctgccacttccctggatatgtcaagaagctgatggcaacttggccaattctggcagatatcaggcccccagttcagccccagtcaccctcttttacacatgtgggtcaaccactgtgtgctcagagggtcagtcccttcctctgctgtgtttttcttgagtccttgcactcacttcccctgccccagtcacgatgacccctaaagcttcctttgcccttgctttctagggcatccctagtgaaggggcaaacctgagatttctccgtggacctgacagccaaggcagggcactgtctcctgaggccagtgccagcacgtgcatggttcacagaaaaggatcctgggctcagaatctcgagaaccgcctgctcctaacaattcagcaagtcaggggcttcctctctgttagtccccaaatccttacttattttaaaaagactagaccctctctaaagactgttccattttaacatgtcctgattctgcatccgtgggttttgtgaaagagagctagctggcggttagagcctggaagaaggagggaagtggcacctcactagcatttatcacttttttccttctctttttaaaaataaaaccagactctgttctgaaaataaaaaacttgagacttgtaaaaaaaaaaaaaaaaaa

SEQ ID NO: 134 - DNA, 2271 bp, Homo sapiens
acattgtagcaaaatggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaag

SEQ ID NO: 135 - DNA, 6413 bp, Homo sapiens
agcagaaagccaccgatcctgaaccagccgccggagccggagtggcgaccgggtgcggagtgggcaaaaagccactgggggaggccagtcccgatcagtcctttctggctccagctccagatcccgtgcggagcaacagctgcggtcgcagtctccaccaccgcctccacctccatcgccgtcgggggaggggccggccggaccccggggtcactgccgaggaatgaagagaggcggccgggccccgcgctccgccccggcctagggccttgccccgggagcccgcgagggtggaggcctgaattttgatctatgttctacctacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctacgtcaagtccatgctggaaacctacccccatcctttagtgaggggagtggtggctccaggacccctgaaaaagggttttctgacagagagcctactcgccctccccgacccatcctccagcggcaggatgacatcgttcaagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcagggcgtttgaactggtgggtgagtgtggatcccacctctcagaggctgcttcctttggcaactactggagatgggaactgcctcctgcatgcagcctcccttggaatgtggggtttccatgatcgggacttgatgctgcggaaagctttgtatgcactgatggagaagggagttgagaaggaagcgttgaaaaggcgctggaggtggcagcagacacagcagaataaagagtcagggctggtatacacagaagatgaatggcagaaggagtggaatgaactgatcaagcttgcctcaagtgaaccccgaatgcatctaggtaccaatggagccaactgtggtggggtggagagttctgaggagcctgtatatgagagccttgaagagtttcacgtctttgtccttgctcatgtgcttaggaggcccatagtcgtcgtggcagacaccatgctgagggactccggaggggaagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaagctgtgatcccacttacagattcagagtataagctgctgcccttgcactttgctgtggaccctggaaagggctgggagtggggcaaagatgatagtgacaatgtccgattggccagtgtaattctgtccctagaggtcaaattgcatctgctgcatagctacatgaatgtgaagtggatcccactgtcctctgatgcacaggctcctctggcccagcctgagtcccccaccgcctcagctggagatgagccccggtccactcctgagtctggagactcagacaaggagtcagttggcagcagttccaccagcaacgagggcggccggcggaaggagaagtcaaagcgagatcgggagaaggacaagaagagagcagattctgtggctaacaaactgggcagctttggcaaaaccttgggcagcaagctcaagaagaacatggggggcctgatgcacagcaagggttcaaagcctggaggggtggggacagggttgggaggaagcagcggcactgagacactggagaagaagaagaaaaactcactgaagagctggaagggtggcaaggaggaggcagctggggatgggcctgtgtctgagaagcccccagctgagtctgttggtaacggagggagcaagtatagccaggaggtgatgcagagcctgagcattctgaggactgccatgcaaggggaggggaagtttatttttgttggaaccctgaagatgggtcaccgtcaccagtatcaggaggaaatgatccagcgctacctttctgatgctgaggagagattcctggcagaacagaagcagaaggaggcagagaggaagatcatgaatggaggaatagggggtggccctcctccagccaaaaagccagagccagatgctagggaagagcagccgaccggtcccccagcagagtccagggcaatggcattttccactggctaccctggggactttactatccctcggccgtctgggggcggagtccactgccaggaaccccggaggcagttggcagggggtccatgtgtcgggggcctaccaccatatgccaccttccccagacagtgccctcctgggcgaccctacccccaccaggacagcatcccttctctggagccaggcagccactctaaggatggacttcacaggggtgccttgttaccacccccctaccgagtggctgattcctatagcaatggctacagagagccccctgagccagatggatgggctggaggtctccggggccttcccccaactcagaccaaatgcaaacaaccgaactgcagcttctatggacaccctgagacaaacaacttctgttcctgttgttacagggaagaactgaggaggagggagcgggaaccggatggggagctcctggtgcacaggttctgaacgggtggaacactgaagggcaaggaggctaaacaaagttaagctcaactaattggctcatcaagaacacagtccccatgttgagggggaaaatgcagtaatgtttgtgggagcctggctggaaacttttaagtgtgtgcacacaggagtgctgccaggctggcaagagcaggtcggggctggatggcacctcaggggctgtactattcctctgcagagcttgacttgatgaggtttgaggtacaaggggaaaagatggcgattctgtcttataacctcctgggtcccatccagggacctaagagaaagtagcaggggaaggtttggtgtgtgggggtgggaggtgggcagaagtcttggggaggaatgggcaaaggaggttctcagtcaataaaaccaaagttctttaggttgggaaaaagcacatggtggagtgagaagtgtggaggggaagtgggaaattggacacatttgctattgatttgaattaagctagaaattaaggttggataaattcttccccttgaaggatctggaaagacaaggcagtaatgtgtcctcatgggtgcctgttaggaggtgggggtagtttaaatccgtttgtttagatgggaaagggaggaacttaagagggaaatccttttcctcttaaggtttatttccttccaagcagtcatatgtcatctgttacagtttgagaagagattgctgattaccccctgtcttttcctcatctaagtctttaattgtatttgtttaaagggaagagtgtggtgagaacagccgtcatgtgtgttgcattttctccaggtgaattggggcagagctgatctattttttaaccacagcaataaccatacgttggggtttgagtgcaccttgggaggggtgggaggacagacattttagccagaggctgtttcaaacaaaaccaaaaacctaagtagagcattacaggcctctgtggctgctgcgtttctgtagaaagcaacttattttattgacttttttttttaaggaaaagaaataaaaagaccccagcaagcaaaaacatttaaaaaatgatttttttccctcctacttaagtggttctttctccctttgctctacttttggagaatgaacttaacatcccggcttcttttgttaagccatagctgaccttaatctgtggttagtttattaaaataattaaaaatactttctaagaagagatatttttgatattaggactgatgttgaaacatataggggcaatttataaaaaggtagttagagaaatatattttagtgaactataaccacagagcacagatgactcccaatgagctgatctgtctttaggtttctccctttccctgacccttccctgttctctaggggctgggagtggggatgcggacacagtagggggagctccttcgcattttgcacaaagcacaagtctgaacagcctatgctctggccagagccatttctaagagctttaaaccggaagacctatcctgggccaattttcctttttctttatatttttttccgggaaaaaaagtcaactatgcaattgtatacactcccgggtgcatgtgaagaaggggaataagtgtacttatgtgtccagagtattaactggggctgtttttctgtgtttggatttctcttttgaggtatgtactcataacccatcccttggaacgtaatccccacatttgatctaaagcacttgagcgtgcatgcatgtgcgtgcgtgcatatgtgtgtgtgttttcctcctcggtagccagtcaagattgtccttgttggaaatgctcacggtttataaaggttattttctcctcaacaaactcagaagtcacctattttccaaatctgatttaataatttcctatggctattaattcttagggttttctttgaaaatagatttgtgttaaggaagcagtgagattccaaaggaagggatgtgtatatgtctaggcaggtctggaacctggtatgagatgagcactcccctaagttgcaaaatttaagggttactataaaactcattaatcaagatactataaaaaatgcagtatttaaaaaaattaatgcaaaaaatttatgttggataaaatagcgaaatcttacaggatctgacaggactgagattaggaggagggaagtgaggctgaattgaataagtatggggatgaatccttcttatttaaatttttgatacattgtccatcatagactttttacattaattgtgattttttaaaaatgttgcattaaaatagtatttatcttggttactgggttttttggcactccttaaattttgtgcccaaggtgagtgctttgctcacctcaccctagttacgtccctgtttctgtgatttgaacactagcgagaacaccactgtgtgcgcctccacccccatcacacaccaaacaacaggtggctcagacaccctgaatttgcacagctcacctagctttcctaatttaggccttcatatcatagaatggtggcctggaccaataggaatgaaaacagaccaggggttttcccagagaataaagccggaaaagttttgattctccactggactgctgtgtttggatttgatctgttgttagattctagttaacacttttgtttttaaaaactaaggacaaatgaacaaaaaaccttgtatcatgtttgtttttatttataagttagccaatcccaattccgtttgctttattttcaaataaaaaaagatggaaattttgaggggtggtctaggggtgaatatggtaaaatggggctttaggccttatagctttttattaagaaataaattattttttttatttgggagggtaactatttattgaggcattgaaaaacctctccattctaaggatgagagaccctgagacaatggatattttttataggagatagtgaagtttgttttgcttcattctttcggggagggttttggtgggatggggggaggtgaaggaataatgcctgggaaattaatatagattcagcttggtttgtggtattttgggaagatgagggaatagaagaggcaagcccatgtcgttactgggttggggagaaggaaagaaggggcatatggcctgcactcgaaatgggcagaaaaattccttagttaaggaggggtgtgtgagtgaagggggaaggtagaccctttaaccccaagtgagggatgatatcatctctcaggcttaaatttaagtgcacttagttcctttaatccagggcaactggggtacctactgaagtttttaatggagaggggagattttcagggttcttgtttttccctttttgatgttagacagtgctactccctccctgctgtgctctctgccccatctccaatggagtaagtattactgtaggataggcctccgcttctcccttaacctatgctgcatttattgaaagttacaagatttaaccagaagtttttcctccatactggtttttatcaacaaaataaaaagattatatccaaa

SEQ ID NO: 136 - DNA, 6975 bp, Homo sapiens
gggagagggaagggggcggagctagccggagccgcgagtccattttggggctgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccagtagcctctagttcgttagtcaaaacgtgaaaaaaaagacctgctttgccctgggaaatagtaaccctgccaaatacatcagcttgtaggagacagagaataacagcacctggccgggtgcagtggctcaggcctgtaatcgcagcactttgggaggctgaggtgggcggatcacctgaggtcaggagctcgagaccagcctggccaaaatggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttttgagatggagtcttgctctgtcgcccaggctggagtgcagtgatgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaaaaaaaaaaaaaaaatatatatatatatatacacacacacacacacatatgtacacatacatatatatacatatatatgtatatatagaacacatggcaagagcaggaaatgggaagactaccttttttctggcagctatgtgttgttttgttcgaaagatggcaagtgtacaaccaaaccaatccacttgcttacagaaagaatgtttagtgtagttaagactaatttgacaacagataaaacagtctgtcagctattacaaagtaatcagctgaacactaatgctgttctgtctgctcacaagagataaagataccctctcatggaataaacaccttgcttagaattcatataacaaagaagtaaccttataactgctctctagtctgccttatttgtgtcatagagtaagatattccttgaaagcccattaagtggaatagactttctgaaaataagagttctttacctcagtcctcctctaatttggttgagaggaggtaatgaaaatggggacaggataaaaggtggcaactaaatttaaagcacagaagaaatgatttccttctagctatgagaatagtcaaattgagcttgccaggctgtctcattcctaacatgtaattcatgatttagccactaaatttctaaggagatcataagaaattaagaaaaacgtttaagtctagcctctgcgtggtagacaggtatggggagggagaatgcttttcccctcccagtaataaaaaaaaaaaaaaaaaaaatatatatatatatatatatatatatatatatatatatatatatatatatatatatagttttactaggttttcatggataagtttttaaatgtaagacaggaaagggatctatttgatgtctatcttcagatatattggcagttttccttaagctatttagttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctggaaaagatgattattcaaaataatgttttggggtaaccagtggagttgggtagaatgaccaaataattattttccaaactgggatactttttagagtgaaaggggctattattaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagacagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatcatttaaaatatacttttttttttttttttggtaaaggtaggcgtattttaagatattttcttaacttgagcagtagccaacaggaaggataccagtgtctctctctcttagcgacacactccttggtcttgcttaccaactggaggacactaggtagaataaccgagtatgacaattcttaattgtttacattttataacttcctgtccttcaaaagagtttgaaatgtcattttgggaaaagagagccagtcaagctagtaggctgattgtgaagaaaatctaataccttatctttatctcaaacctctgtacaactttattttcattgatgggatactttaacaaaaatgaaattttttttggtttttaaaatatgagtgattatgacctctttggggatcatgcttcaaaaagtcagaaacctagagacaaaactgtcattgatttttaagaagaaacacactaggtcaaaagaagatgtcctggaaatatgaagtactctttaaaaaccatgcatttggagaaagtaattgtttccttgaaaaacatgattaaaaactaaaactgggatgttcctgtgtgtacacagtgccaaatggttttccctttttatgttgtgttttagaaacagcacgaaagttttttccattttaaagtgagaaaacattatatttagacttccataattccaaaatcagaagctatttttaaaattagcattttcttgcatcaccaaatggtattcaattgtttgaagctcaaaatttttaccattccataaatgtttgtgaatttttagacagtgccaatttaaaagtagagatagccaatctgaatacggtgaaattatggggatctctggtgattgggatgaaaactctggccttaaaaggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaactttttttgagatgtgaaaaaaaaaaaaaaaaaaaaa

SEQ ID NO: 137 - DNA, 3174 bp, Homo sapiens
tgccgccgctccctactctgggggttgggactacctccttttccgcgggccccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcataaa

SEQ ID NO: 138 - DNA, 4562 bp, Homo sapiens
ggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttaaaaaaaaaaaaaaaatgacatacgtgacagctcacttttcagttcattatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggg

SEQ ID NO: 139 - DNA, 1064 bp, Homo sapiens
cgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaatttttaaaaaaaaaaaaaa

SEQ ID NO: 140 - DNA, 6457 bp, Homo sapiens
gtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgagttttggaaatctagtcctagtattctggccgttcagagatctgcaatcctcaagaagcagcaacagcagcagcagcaacaacaacatcaagcctcatctaatagcggatcagaagaggattcctctagcagtgaagattccgatgactcatcaagtgaggtcaaaaggaaaaagcataaagatgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaatagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggagctactggtgctactacaaccatctatgcagttgaagcagatggtgacccaaatgcaggctttgaaaaaaacaaagaaccaggagagattcagtatttaattaaatggaaaggatggtcccatatccacaacacttgggagacagaagaaaccctcaagcagcagaatgttagaggaatgaaaaaattggataattataagaaaaaagatcaggaaacaaaaagatggttgaaaaatgcctctccagaagatgtggaatattataattgccagcaagaacttacagatgatctacataaacagtatcaaatagtggaacgtataattgctcattccaatcaaaagtcagcagctggttatcctgattattactgcaaatggcagggccttccatactcagagtgcagctgggaagatggagctctcatttccaaaaagtttcaagcatgcattgatgagtattttagcaggaaccaatcaaaaaccactccttttaaagattgcaaagtattaaaacaaaggccaaggtttgtagccctgaagaagcagccatcctatattggaggacatgagggcttagaattaagagattatcaactgaatggtttaaattggcttgctcattcttggtgcaaaggaaatagttgcatactcgctgatgaaatgggccttggaaaaacaatacagacgatctcatttctgaattatttgtttcatgaacatcaattatatggaccttttttattggtagtaccgctctccactcttacttcctggcaaagggaaattcagacttgggcttctcaaatgaatgctgtggtttatttaggtgacattaacagcagaaacatgataagaactcatgaatggacgcatcatcagaccaaacggttaaaatttaatatattgttaacaacttatgaaattttattaaaagataaggcattccttggaggtctaaattgggcatttataggtgttgatgaagcacaccgattaaagaatgatgactcccttctgtataaaactttaatagattttaaatccaatcatcgtctccttatcactggaactcctctacagaattccctcaaagagctctggtctttgctacatttcattatgccagaaaagttttcttcctgggaagattttgaagaagaacatggcaaagggagagaatatggttatgcaagccttcacaaggagcttgagccatttctgttacgccgagttaagaaagatgtggaaaaatctcttcctgccaaggttgagcagattttaagaatggaaatgagtgctttacagaaacaatattacaaatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggatttttgctttttgctgtccacaagagctggaggtctagggattaatttagcctctgctgacactgttgttatatttgattccgattggaatccacagaatgatcttcaggcacaggctagagcccatcgaattgggcaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaattgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaaaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaagga

SEQ ID NO: 141 - DNA, 2936 bp, Homo sapiens
gcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccaggaagattaaatggtgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattccccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttgatacctgtaatatagggaaacacaactttttttgggaaagccctttgaccccagcttgctagttgcataataataaattttctgttcct

SEQ ID NO: 142 - DNA, 9374 bp, Homo sapiens
ctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagaaaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcaaaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggcaccatcatgactccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgcaccctgcagtctcagatcctcgctcacccccttctcagaaatctcctcacgattccaagtcacccctggatcataggtctcctttggagagatcactagaacagaaaaacaacccagattataactggaatgttcggaaaacataaaggacagctcgtaaaggagagagtaagagtcaccaaacacgtggatatttttggtctgatcctacagtagccggttatctagaccagtaagtggagttttggacatgctgctgctgtcaactcactggctgaaggagcacttcaaggaatgggaggcctttcactgggtccagctctgattcgggtcaccactcctgcactttggcaccccatcccattccagcctagttctggcctcccactttgacgggcacttggaggaggagctgactgtgtgtgtaccagcttcactgggatgtgtttccccagtcaaggaacaggggatcttcagagtcatgaatgttttcttgccagggtcagtgttcccaggaccttagtgcatggtcggggcaggaactggtgcatggaggctgctgggacctggtgaacagtgtgtgatttggttgatttggttcactctgacatgatggatgctgctgatggggagtggcgagttggggcaagcgggtggggacaagcataggacttgaaggggagcaggtacacccctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgggcctccttttcccactgtgccagggaaggtaggtttctctggctgactgagtactgtgagtgaggcaacactgatgccagcatgggtcttacttgactggggagtaggctgagtgaggggtagggtggggtaggtggggagtagtgtggccagggaactggaatccctggtggatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtattgcgctaggtcaacacttcctgctgcatttccttccctttgcacagcttgaagaaatagagtagacagaatcacacatcatgtggtgggcagatggaaataagtacctgtggtgaacaagtttctactgtagttggagatcattagaattgaattcagtttctcttagaatataatcaggtataaacctaagttaaactttttcccaaacaaggagcatccaaagacacagtgacttgagctatagatagtaaaaatcatacgagagttgaactgagtcaggtttaggaagcaagtttggttgcatcaattaagcaggctcttttcaattgactgatgctggggccttcagttttattctcagtatagattgccagtattgttaagagtatccaaaggcctttctagatggagacagaataactgacttgaacatacagtgtgcctgtaagtgtccaggctcagagctggtgaaaacccttctgttgggcgtgtgcagggttaaactcctgaagtaacttgtgaggacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctgccgtgacgctcagtggagagggcagggcctgtgtctccacttaggccacacagtgatgaggaaaccacagatggagcttcttgccgataatactgactctagcccatgattgccttgcccaagccaaagaggaaggttaggttggcttgtcgagcccttgagcgttgggagatggggtgggaaggaggtgagcccctgcagagagttgggtagtgtccttcaggaatgaaaggaggggcaaaggagtcaccagaggtcctgcatttccatcagggtttccacagtcatcagggcttctctcttgagttgctgataggagatgtgagttatgcccagagatgtcttatcgtgaggaaaaagaaacttccttttgttcacatttaggactctcagtgccatatgaagtagcaaaaggcagtatcggccagatcagtgttacattgattctaaaattacagtgtccccattagacaactattttaggtgctggagtatgtttgaagagtgtgctgggaaaaaggaagcatttcttcattgatttaaatcagtatgaatattatatgcctaaataaaaaatttgcacaggtaaattctctcacttgtgaatgggagaagctgccccaggaatctgtgaggatggtattccctggagtctggctttgaaagatttcattgttggtagaaataacaggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaactgctgtacttttgattcttgtatattaaaaagtgttactgagcatttttagaattgggctaacaaaaaaaaaaa

SEQ ID NO: 143 - DNA, 6331 bp, Homo sapiens
atctttgtttgggtctcccatactgcgtatagatgaatgggtcaggatatctggaacaaaatatggaggtgaagggtgagatcgggaaacaaagggtatggccccctagttcccaaagggagcagggagatgggaatagaattgaaggtaggttttaggctacttgggaggaggaatatttaggtaattgtggagactttctcctgtgtgatgaaggcggcagacactgtgatcctgtgggcaagaagtaaaaatgaccagctgaggatttcttttcctccaggactgtgttggggtgacaggatgcctgataaggatgacattcggctgctgccgtcagcattgggtgtgaagaagagaaaacgaggacccaagaagcagaaggagaacaagccaggaaaaccccgaaaacgcaagaagcgtgacagtgaggaggaatttggttctgagcgagatgagtaccgggagaagtcagagagtgggggcagtgaatatggaaccggaccgggtcggaaacgaagaaggaagcaccgagaaaaaaaggagaagaagacaaagcggcggaaaaagggggagggagatggggggcaaaagcaagtggaacagaagtcatcagcaactctgcttctgacctggggcctggaggatgtggagcatgtgttctctgaggaggattaccacacgctcaccaactacaaagccttcagccagttcatgaggcccctaattgctaagaagaatcctaagatcccaatgtctaagatgatgaccatccttggggccaaatggagagagttcagtgccaacaaccccttcaaggggtcagcagctgctgtggcggcggcagcggcagcagcagcagcagctgtagctgagcaggtgtcagctgctgtctcgtcggccacccccatagcaccctccggaccccccgcccttccaccaccccctgctgctgatatccagcccccacccatccgaagagccaaaaccaaagagggcaaaggtccaggccataagaggcggagtaagagcccccgagtgcctgatggacgcaagaagcttcggggaaagaaaatggcaccactcaaaataaaactagggcttctgggtggcaagaggaagaaaggaggctcgtatgtttttcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaaggtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacatgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacagtgtggataaaaaggggaattaccactatctagtaaaatggagggacttaccatatgaccagtccacgtgggaggaagatgaaatgaatatccctgaatacgaagaacataagcaaagctactggagacaccgagaactaattatgggggaagaccctgcccagccccgcaagtataagaagaagaagaaggagctacagggtgatgggcctcccagttctcccactaatgatcctaccgtgaaatatgagactcagccacggtttatcacagccactggaggcaccctgcacatgtatcagttggaagggctgaactggctacgcttctcctgggcccagggcactgacaccattctagctgatgagatggggctaggcaagaccatacaaaccatcgtcttcctctactcactctacaaggagggccacacaaaaggtcccttcctggtgagtgccccactctctaccatcattaactgggagcgggagttccagatgtgggcacccaaattctatgtggtgacatacacgggtgacaaggacagccgggccatcattcgtgagaatgaattctcctttgaggacaatgccatcaaagggggcaagaaagcttttaagatgaaaagggaggcacaggtgaagttccatgttctcctgacatcgtatgagctgatcaccattgatcaggcagcacttggttccatccgctgggcctgtcttgtggtagatgaggcccatcgactcaagaacaaccagtccaagtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggcccaattcaccgattttttaaaaaagttccagaaatccagtgacgaatgtggtatacaaaaaaatatataaattctttcaacttagaataattaagtcataaaatacatagggtacaaataccacattccgttctaaaatgatatcttaggatcatcaaaagaaaaagaggatttggattatgcaaaaaatgattcctatatatataatcaattatctaactgacatttttgcaaatctaccacaacttcgccttttattgcatatgctaaacaagcagatgctaagtctgtaaactgtgaattaacctcctttttaattaattgttcg

SEQ ID NO: 144 - DNA, 6511 bp, Homo sapiens
attttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaaggaaaaaaccaaaagcataaaaaaccacagcaaatttcttgatgaaaattgaaaataaaagtttccttgtattttaaaaaaaaaaaaaaa

SEQ ID NO: 145 - DNA, 9646 bp, Homo sapiens
tcgcccgccgcgcgcgccggtccggcagcgcacgggttaaggctggcaccgcgcccggcgggagggggggcgcccacctcccctcctccccgcgccgggcatgcggggcccagtgggcaccgaggaggagctgccgcggctgttcgccgaggagatggagaatgaggacgagatgtcagaagaagaagatggtggtcttgaagccttcgatgactttttccctgtggagcccgtgagccttcctaagaagaagaaacccaagaagctcaaggaaaacaagtgtaaagggaagcggaagaagaaagaggggagcaatgatgagctatcagagaatgaagaggatctggaagagaagtcggagagtgaaggcagtgactactccccgaataaaaagaagaagaagaaactcaaggacaagaaggagaaaaaagccaagcgaaaaaagaaggatgaggatgaggatgataatgatgatggatgcttaaaggagcccaagtcctcggggcagctcatggccgagtggggcctggacgacgtggactacctgttctcggaggaggattaccacacgctgaccaactacaaggccttcagccagttcctcaggccactcattgccaagaagaacccgaagatccccatgtccaaaatgatgaccgtcctgggtgccaagtggcgggagttcagcgccaacaaccccttcaagggcagctccgcggcagcagcggcggcggcggtggctgcggctgtagagacggtcaccatctcccctccgctagccgtcagccccccgcaggtgccccagcctgtgcctatccgcaaggccaagaccaaggagggcaaagggcctggagtgaggaagaagatcaaaggctccaaagatgggaagaaaaagggcaaagggaaaaagacggccgggctcaagttccgcttcggggggatcagcaacaagaggaagaaaggctcctcgagtgaagaagatgagagggaggagtcggacttcgacagcgccagcatccacagtgcctccgtgcgctccgaatgctctgcagccctgggcaagaagagcaagaggaggcgcaagaagaagaggattgatgatggtgacggctatgagacagaccaccaggattactgtgaggtgtgccagcagggtggggagatcatcctgtgcgacacctgcccgagggcctaccatctcgtatgcctggacccagagctggagaaggctcccgagggcaagtggagctgcccccactgtgagaaggaggggatccagtgggagccgaaggacgacgacgatgaagaggaggagggcggctgcgaggaggaggaggacgaccacatggagttctgccgcgtgtgcaaggacgggggcgagctgctctgctgcgacgcctgcccctcctcctaccacctgcattgcctcaacccgccgctgcccgagatcccaaacggtgaatggctctgcccgcgctgtacttgccccccactgaagggcaaagtccagcggattctacactggaggtggacggagccccctgcccccttcatggtggggctgccggggcctgacgtggagcccagcctccctccacctaagcccctggagggcatccctgagagagagttctttgtcaagtgggcagggctgtcctactggcattgctcctgggtgaaggagctacagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccattgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagtcgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagggcgctttcggctcctcccagatgtacagcaacaactttgggcccaacttccggggccctggaccgggagggattgtcaactacaaccagatgcccctggggccctatgtgaccgatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcgaacctgcagcactgatgtctctttaccgatgggttccagacccaaggtagtcctggcactgccctgtggactcagcccagctggggaggacatggcgcccggtgccctaggagccctcagtgtcccctacctgacctgtctgcacctgtgtgacagccccttctgatttggccccctgcccgcttggagcctcccagcaccagacagggcaggtttggggagccgctgtcgagccctatggtgagaccctggctgacatttcccctccttcctgccaaggctggaggccgccaggtgtttgctctctccttgtggggaggtggatcctctgccagcaggtgtctgtccccggcccagcgcatcttgaaggccctggactctgttaccagtggggggcctgtggccccggctcttcacagcaggcagaagcgtatgatcccagggagggtgggctgggggggggccagcacttgcctcggagccactgctgcgttgggtttgccttctgccagaggtgtggttaagggcagtgatagctgcgccccagcaaggagggtcatgggccctgagctggcccaggagaccctggccctgccctgtgccctgggatgcctaccctgcccacctccggaggtggaaccgggctgcccctgggggcctggacttgtcccattcccctgtccctggaaaggccttcccgggggctttttgcctgaggctgcactcttggaaggtgtggggagagttctgcctggagggggactggacccagtgccctctgcagacccctcccagccgcagcaccaagggcttgctgccttgtttcctgccaggagcgccctgacatcccaaaaccatcttcccacatgtgggttgttggaatcccacccactcccccggaccctgcccctccaagttggggacggagatggggagcaggtcaggccctccctaggcctgtttgtgtgtgatccttctcctggccccaggtcgacctggaaggcgtttctgagtcttgtactgggaccttcccagggaaggtgccttggggtgcagaatcctgggaatgttaggaaagggctgcgtgaaaaacccagctgggcctggggtggaggtgcacacgggctggggctcagctccttggagagggcctgcctgggactgagggggccagggctgggtcaggattcaccagcttgtgttgcagacactggagcaattgcctggccctccctaagccctatatgcctcactcataatgaggctgtctctgaaccccggagggcgggacctacaagtccttcctcttggcgcattcccacactccagtctggatccaggtctgcaaggccagcccgaccctgacactgcacgtgggcgtagtggggagcaccctggagtggagatgattgtcagcgggctcacatgttatggttcatccacatgcgtgttgtgtgctctgcggtgcctcctggcaaagggtcctggctcgggtcagaagctcactcccgtgccctcgtccccaaacaagcagtggcaagcactggggttggccctcgttgggagcagtgcccaccttccttggcccacagcagataggtcccgagcagcaggactggaggcctgtggcggtcagggcaggggtctgtgtctccaccccaagggctgatggtccctcccctgtgcgccttcctctcaggcaggcttgctctgtcccttcctctctgcttccctcccaggcctcgccagggctcccttctcctctgcctggttagactcgggcacccaggaaagcctggccagggctcctttgggcctgggccccctgcactgcctggtccagaaggggtggtgctgtccgtggccagcaccccggggcccgggaggggtgggctactagagtcagagcgggtttggggctgaccagtttgggagaggagaaaagatctgagaatgtccttcttggtttgtcagtcatctctgccaaaagtggtgatggtggtgtccgtatgtttggcgtctttgggctgggtttggtttttgctgctggtagaatcagggtcctcgggcatgaacgcgagcccaaagtgccagtctgcgattggaaatttccagccactttaagccagtgctgagtagggcttctgcagagccatgtttgagccaaggtcttggaaggcattgccccatgggctcaggtgactcggggtggagtgagcacgtctgcagggccctctcatacacgcctgaggcagaagcagcgtcccccgtgaaagccaccttccgaagctcctgcgttttttgcaaacttggcttcccccaggggcaggctggactttccctgccccctatgattgaagtcctcctgcttttgggggctgccttcccagagtcccccgggtgctcccctgccgaggtcaggagctgaccaagccttggcccggtgacacctgcagccctcactcctgtcatcccaggacacttgaggcccaaggaggtggagtggagagtgggctcgggtacatgggagccagaagccagatggacttggtcaagtgttggtcacttggagcctccagtgtgcgtcagggtctgtgggcaggggacagggcgtgggtgggggccgaggctggcacgcccctctgccctcaccgtcttggtgacctggcctcggcccctcccccaagtctcttctgtgcaaggcccgcctcggcctcggcagctggttcctgtcccgttttctgtgtctgaaagtttacaggttgtggtgcatcagcccaaactcactggcgttgtgttttttttttctttaattttcagattttttttttaaacaaagtatttttttaggtgcgataacccagaaagggcccgttgggtgtgtgtgtgtgtcctgaactcctcaagcagcgattggagcccaagcacccctggagaggaagggagggtccccactggcccgtggggtctgagttcaggggtgtggagggagcagactccaccggcccaggcccagctaagagggggccgacccctttccccaggcacagccccaggctggcaaagggagggccctgggctgggtgcagggcgcgccaggagtcccagccagggtggccccggcgggggcgggtccagctttggaagccaggctcccctgtgagccgtggcttgtctggtcttcgcccacgggaggctggacagaggctgtagccaacacaatcacctttactttgtactctgtgtgtatgttttggttttctgtgttttaataaatcctttgggaaagg

SEQ ID NO: 146 - DNA, 10389 bp, Homo sapiens
atgaccaatgggtctgtgttttggaccggcgaagcccaatggcgcgacagggaaggcgggcccgagatgggttagggtgtccttgcagggtgtctgagctaaacttcaccaaataatagctgtttgtattttggctgctgcaggagccattttagaaataaatatcttccttcaatagatgaaaatgaaaatacagaaaaaagagaagcagttgtcaaatttaaaagttttgaatcactccccaatgtctgatgcctctgtcaattttgactacaaatctccatccccatttgactgcagcactgatcaagaagagaaaattgaagatgttgctagtcactgtctgcctcagaaggacctgtatactgctgaagaggaagctgctaccctttttcctaggaaaatgacatcccataatgggatggaggacagtggaggaggaggtactggagtgaagaagaaacggaagaaaaaggagccaggagaccaagagggtgcagcaaagggaagcaaggacagagagcccaagccaaagaggaaacgagaaccgaaagagccaaaggaacccagaaaggccaaggagccgaagaaggccaaggagcacaaggagccgaagcaaaaagatggggcaaagaaggcacggaagccccgggaggcctcgggcaccaaggaggccaaagagaagaggagctgcactgactctgcagccaggacgaagtccaggaaggccagcaaggagcaaggaccaaccccagtggagaaaaagaagaaaggaaaaaggaaaagtgaaactacagtggagagtttagagctggatcagggcctgacgaacccatctctgcggagtcctgaggagtccactgagtctacagacagccagaaacgacgctcgggaaggcaagtaaagcgcagaaaatacaatgaggacctggacttcaaagtggtggatgatgatggggaaacaattgctgttcttggagctggtcgaacatctgcactctcagcctctacactggcctggcaggcggaggagcctccagaagatgatgcaaacatcattgagaagatcctggcatctaagactgtccaggaggttcacccaggagaacctccgttcgacttggagctgttctacgttaagtatagaaatttttcctacttacattgtaaatgggccacaatggaagagctcgaaaaggatcctcgcatcgcacagaagatcaagcgatttaggaataaacaagcccagatgaagcacatttttacggagcctgatgaagacttgttcaatccagactatgtagaagttgatcgcatcttggaggtggcccacaccaaggatgcagaaacaggggaggaggtaacacattacctggtgaagtggtgctcactaccatatgaagaaagcacgtgggagctagaggaagatgtagatcctgcaaaagttaaagaatttgaatctcttcaagttctccctgaaattaagcatgtggagcggcctgcttcagactcctggcagaaacttgagaagtctcgcgagtataagaacagtaaccagctccgggagtaccagctggaagggatgaactggcttctttttaactggtataacagaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggagctgtgtgataattgatgaagcccacagactgaagaataggaactgcaaacttctggagggtctaaagcttatggccctggaacataaagtgcttctcactggaacacccttgcagaactctgtggaggagctcttcagtttgttaaattttctggagccatcacagtttccttcagagaccgctttcttggaggaatttggagatctgaaaacagaggagcaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgatacctgcatcatatttgattctgactggaacccacaaaatgacttgcaggctcaggcccgatgtcaccgcataggccagagcaaagctgtgaaggtgtatcgcctcatcactcgaaattcctacgagcgcgagatgtttgacaaggccagcctaaagctggggctggacaaggctgttcttcaggacatcaaccgaaagggcggcaccaatggggtacagcagctctcaaaaatggaggtggaggacctactccggaaaggtgcttatggagccttaatggatgaagaagatgaaggctccaagttctgtgaagaagacatagaccagattctgcagaggcgaacgcacaccatcaccatccagtctgaggggaaagggtccacttttgccaaggctagctttgtggcttcaggaaacagaacagatatttccttagatgatcctaacttttggcagaaatgggctaaaatagctgaactagacactgaagcaaagaatgaaaaggaaagcttagtgatcgaccgacctcgcgtgagaaagcagaccaaacactacaactcgtttgaggaagacgagctcatggagttttcagagttagacagcgactcagacgaaaggcccacgagatccaggcgcctcaatgacaaagccaggcgctacctccgagcggagtgcttccgggtagagaagaacctgctcatctttggctggggccggtggaaggacatcctgactcatggccgattcaagtggcatctgaacgagaaggacatggagatgatttgccgtgccctcctggtgtactgtgtcaagcattataagggggacgagaagatcaagagtttcatttgggaactgatcacacctaccaaagatgggcaagcccagaccctccagaaccactcaggcttatctgccccagtccccagagggaggaaggggaagaagacgaagaaccagttgctaatcccagagctaaaggatgcagattggctagccacctgcaaccccgaggtggtcttgcatgatgatggctataagaaacacctcaaacagcactgcaacaaagtacttttgcgagtccggatgctgtactacctaaaagctgaaatactgggagaagcagctgagaaagcatttgaaggatctcctgccagggagctggatgtacctctgcctgacatcgactacatggagatcccagtggactggtgggatgctgaagccgataagtcacttctcattggcgtgttcaagcatggttatgaaaggtacaatgccatgcgagcagacccagcactttgcttcctggagaaagttgggatgcccgatgagaagtccctttctgcagaacagggtgttacagatgggacctcagacattcctgaaagaggcaacacagataaagaagacaatgctgaggacaaagtagatggcctccagaaacaaacggagagttccagtgatggaggtgatggcgtttttagcgaaaagaaggatgacagccgggcagcccaggatggctccgacccagacaaatcgccctggccagtttcctccgccctcacagctcgtctcagacgtctggtcactgtttaccagcgctgcaaccgcaaggaactgtgccggcctgaaattctgggaccaggtaaccaaggatattgggttcaggaagagatgttcaggagaacctcagaaatggacctcatcaacaaggaagcccaaaagaggtggactaggagagaacaagcagacttctatagaacagtgtcttcctttggtgttgtttacgatcaagaaaagaaaacctttgactggacacagttccgcatcatttcccgtttggacaagaagtcggatgagagcctggaacagtatttttatagttttgtggccatgtgccggaatgtctgtcgtctacccacatggaaagatggcggtcccccagataccaccatctacgttgaacccatcactgaggaacgtgctgcaagaactctgtaccgcattgaactgttacggaaagtccgagagcaagtgctcaagtgccctcagctgcatgaacgcctccagctgtgcaggcccagcctctacctcccagtctggtgggagtgtgggaagcatgatcgagacctgctcatcggcactgccaaacatgggctgaaccgcactgactgttacatcatgaacgacccccagctgtccttcctggatgcctatagaaactatgcccagcataaaagatctggcacccaggcaccaggaaatctctgttgcctttaccagaccaactccaagttatatgaatctcttacatattctcaaatgagtaggacttcagagtcccttgaaaatgaacctgaaaatctagtgagagtagaaagcagagatgatcatctcagcctgcctgatgtgacatgtgaaaactttatttctaaagttcaggatgtcatttccatcaaccatgatgaaagtctgctgcctgagtccttagagagcatgatgtatggtaagaaggtgctcagccaagaaccaagctcttttcaggagagcccaagtaccaatactgaatctagaaaagatgttattaccatctcaataagcaaagatgggaactgccagtctggtggccctgaggcagaaatagcttctggccctacttttatgggtagcttagaagcaggaggagtagctcaagcaaacatcaaaaatggaaaacatttgttgatgtctatttcaaaggaaggggagctctgctgcagtgaggcaggacagagacctgaaaacattggccagctggaagccaagtgtttagcttccccttccttgaatccaggaaatgaaagtgggtttgtagatatgtgcagtcttagtgtctgtgactccaaaagaaacctgtcatcagatcagcaattaattgatttattggaaaacaaaagcttagaaagtaaattgattttgagtcagaaccacagtgatgaggaggaagaagaggaggaaaacgaggaggaaaacttagccatggcagtaggcatgggggaaaggccagaggtattgcatctcacggagcccactactaacatctcaagggaaaagaaccaaggcttccaagatgaaaccaagaaaggaagcttagaggtggcaaaccagactcctgggctacagagggctttccccgctccagcagcctgtcagtgccactgcaaacacatggagaggtggatgcatggcctcgagaatgatgaatttgaaatcgagaaacccaaggcttatatcccagatctgttcaaaagtaaaaccaatactatcgccatggagggtgaacccactgctattccatcacagccgtttaaagtgaagcatgagcttttaaaagaaccttggaaagaaagtgcagaggggcaaaacgttttccccacatatcctcttgaaggaagtgagctcaaatcagaagacatggattttgagaataaagatgattatgatagagacggaaactgccatagtcaagattatccagggaagtactctgaagaggagagcaagagctcaacatcgggcatcacaggagacattggggatgagctacaggaggctcgagctcccactattgctcagctgctacaggagaaaactctctattccttctctgagtggccaaaggaccgcgtgataattaaccgcctagataatatctgccacgtggtgttaaaggggaagtggccctctagccagcagtatgagccctcaggcacactgcccaccccggtattaaccagcagtgctggttctcgaaccagcctctcagagccggaagcagcagaacacagcttcagcaacggcgcagcattggcggcccagatccacaaggagagcttcttagctccagtattcacaaaggatgaacaaaagcacaggcgtccctatgagtttgaggtggagagggatgcaaaggctcggggcctggagcagttctctgccacccacgggcacacccctatcatcctcaatggctggcatggggagtcagctatggacctctcctgctcatcagaggggtccccaggagccacatcccctttcccagtgagcgccagcacccctaagattggggctatcagttcacttcagggagcccttggcatggacttgtctgggattctgcaagctggcctgatccatcctgtgactggacagattgtcaatggaagcctcagaagagatgatgcagccacgaggaggcggagagggaggcggaaacatgttgaaggagggatggacctcatctttttgaaggagcagacacttcaggcgggaatcttggaagtccatgaagacccagggcaggccaccttgagcaccacacaccctgaggggccagggcctgccacctcggctcctgagccagctacggcagccagcagccaagccgagaaatccattcccagcaagagtctgcttgactggctaaggcagcaggctgactactccttagaagttcctggctttggggcaaatttttcagacaaaccaaagcagaggaggccacgctgtaaagaacctggaaaattagatgtcagctccctgagcggggaagagagagttcctgccatccccaaggagccaggactgagggggtttcttccagaaaacaagttcaatcacactctggctgagcctattcttcgagatacgggcccccgcaggagggggaggcggcctcggagcgaactcctgaaggctccttccattgtggcagactctccctctggaatggggccactgttcatgaatggactgattgctgggatggacctggtaggacttcagaacatgagaaatatgccaggcatccccctcaccgggctggtggggtttccagctggctttgccacgatgccaacaggtgaagaggtcaaaagtaccctgagcatgctgcccatgatgctgccaggcatggctgctgtgccccagatgtttggtgttgggggactcctcagtccacccatggcaaccacctgcacttccactgctccggcgtctctatcaagcacaacgaaaagtggtacggcagtgactgaaaagactgcggaagacaagccgagtagccatgatgtgaaaacagacactttagctgaggacaagcctggtccaggtccattttctgatcagtctgaacctgcaataactactagtagtcctgtggcttttaacccatttctcatcccaggagtatctcctggactcatttacccatccatgttcctctcccctggtatgggcatggctctgccagccatgcagcaggccagacactcggaaatagtaggtctggagagccagaagaggaagaagaagaagacaaagggggacaaccccaactcccacccagagcctgctcccagctgtgaaagggagcccagcggtgatgagaactgtgccgaacccagtgcccctttgcccgcagagagagaacatggggcacaggctggggagggggcactcaaagactccaacaacgacaccaattagaacttttttcatttaagaaattattgtgacttgtaagtttcttatcccataaaggtttgttacttccctcacttcacctccataagaacctgtgtttccataagtaagattacgtacctgatttcctgtctgagaactatggtaacagatgttaatagttgcagggtctcaccacttcattagataagtgttgtctacctagtctaggaggcacagaattctcattctgttatccagttcattccagcaatcatagttaatacagtacttggtgacacgccctacccccttctcttccaagtttcccactcacttgaggaggaaaaatggcaaaagaaagctgtctagggttttaccattgaagggtggaagaacagagacaaagaggagctctttttctgtgagctgggttgcacaggaagaatgtcacagggaaccaaaaagcacagaaaaaggaagtgctggtgcatatttttgagttaaaatatttccctattttatcatgattactaagtgagtagtatagacagaagtatataactaatggttgaaaatacatatattcatttctttataaaaaacaaaaaccttaccggtagtaatataatttcccccttggtggtttttcagacacctgcagcaagaagaaatactgactgactaggcattattttctatacatccctctcaccagtgaaaagattcctcttgctgcgagaaagctttacccaccatgagttattgctgtcgacgggggtggggcaaggacccgcgctccgtagagctacacgctgcttcacaagcacacggctagcgctctgctctcacctggttcgcttacagatttctctagccattaatttgcctctctgtgtttaaagagcaccaggaccgaatggattttcacttcaggctttccttcaccaagaataaggttctttctggagcctgcaagaagacagttgcccaacactttgacacttgctagtaggtcctttgatcaagagtgtctgaggctgtcaaatgtgtgccaccctttataatacagctatgaaaagttacttctccattaatttctccattctgtttatatcttacagttggacccaaattccaaattatcagttaatcgaaactacattgcaagtcaacattattttctcttcttcctcagcttctccatgtttaggaactgagaaagaacctgcctaagcagcacttccccatgtcctttcaccttcatgttaacgtcccttctgatggtctcactcttcacaggtagttcacactctgagacttgaagtaagctcatggttcagtactctgggggcgcagggctgcgcaggacccttggaaatgttgcaagtgttactagtaccagtttcactttttgttgtcacaatttactgtattttttactttttctgttacagttttgctaatttatcagaaggtccaaaagtctgacataactatttcattttgcattatttatttatgatgcttttttcattgtcttttatacatttgggattataaattatgtaaatgttaaaatgagcatctcaaagaagtctgttaaatcatgactgaaaaaaatcaatcagatgtatcttcaaaaagtggagtcccagttttatgaatcagagatataaaccagaaattctataactgatcatagaagaagaatccagtaattgaacaaatcctatttaatgacatccttgtagcatagatggtctataatgctgaccacagatttcttagaaatgctgctctctctatttaactaacattttgttcagttttgcctccagtggaagcagaaagggttttttcagctgttaaatcctaaaaatcaatataatttatttatgtaagaaaaataactcaatcaatatatttttgaaccttttaagtactaattttctttttatcaagtagaaaaaaaaatgtatttgccctaaatccttaaaatacaaatgctataaaaattcctgtatcttgaaagccttactgcaaatgagtattatagacatccagcagagtctggttttctttgt

SEQ ID NO: 147 - DNA, 7907 bp, Homo sapiens
gggaggacgcgcggcgcgcccggcggacgccgcaggtcccatgccgcgccgcgacccccgcgcccctgccgcccgcgcccgcggccgccccccgccgcccgccgccccgggctcgccgcgccgcgcccgcgcgtccttagcggggccaccgagcgatgcccgccgggcgcccgcgaaagtttgtcggctcctgctgaagggcagcggcgcccccgcacccccgtgccccgctccggccaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgcctgtaatttttaagcccttaggcttagagtttcttttggttttcttcttttttctttccttttctttgctttctttttttcctttttgtttttgtttttgttttttgtttttgtttttttttcgggttattttgttttggttttttgaagcaggtgtttaaggtttaaccttcttcagggacaaattctgactgttggggaacttactctgcaatataaaaatatcttcatgctctggtagggcttggatggttgaactctgtactgccttgtgtgcacttcagccccgaccccctctgattctctgttgaaaagtgtgtcctttctctctgtctgtacatgtttaacatgacgcaataatttgagggcaaacttagtagtgagtgtgtatgatagaatcaagagaattatgggacgcttacttgagaaaatcattaccatgatttggttctaggaaaaaggcagtgaataattatgcaaattagccagaagaaggggaaccgtgctaatgggccttattgggtgaggggacgagatggggttcatgtgaaggaggaagcgatgccgaggtaggaaaggccagccccagacatcctatcgccacaatgccatgtcgcaataggaagcaggggccggccatcgctaccttcagcacactgaccaacctggaattaagaccacctagattgcgagagctgaatttagaaaccagacaacgtcatgcagcccagaaactcctgttgttacctttgcctaagaaattttctttaatggcgggggcggggggcgggggtacaaagagaaatctctaaaagaatatgatcttccatccaagtggagggaaactttaaaacaaaaacacccagtactgtggctcaggatatgatgcgtgaggagagggagggaacagagatgaccttaacttttaaaaaagggactgctgtgggccaaagccaagcccatctgccaggacgaggtaatgtcagagctccatcagcccggacagtgggaactaactggtgcattccccacacttaccttccggtgggttgctgatgagagaacctgaaaaaacctacacctctacagcaggtcgaattcatgacctgaagctgaatacttccagcatatttattcagggtgtaggtgggaataaagtatcttcgcagtgctctgttccctccgtctccccagacatctgacaccctaaaagccatccacagctatggaacctgagcgacaccttgatttgtgttgtcacctgaccaagcctaaagacctccagctcagtcccccaccttcatcccaccccacagatgataaaattcagacctctctcctgaaaggcagaggttcaacattcaggactgtttctggccgaggacttcttccaattaaaacccccaccgtgggctgtctcccctcatttcatttttctaaaggggcagaggcctcttttagaaaataataaaatgcaatgtgtgtgatttacttttctgatctctttgagaaatagagaaatataaaagtgtgttcttaactccagaaccactctttttgcataaatacctcatcgggcagctttctaagtgtgattttcctgagtctcccttcgttggatctgccggaagacttgtcggggaacctttagtgagggtacttcttcctatttttcttctgtttttggaggcatacacattatgcataaccaaaacaatggctcaattgtgtttaactttgtattttgattgttgagaacaaaaacaaaaagtatcaatgtgtatgtggctgtttgtagtgaatttattggagaatgaggttgtccgtgtccttaacaagccaaggggcaggaggcaccctctcttatcccctcctccaagagcagtagagaatttaagcacaagcctatttgtgaaagaatattttgcttaagtgtcattcactttagtcttggaattccttcccaaacgtcaggtgttcttttagcttccaaactagcatatgtatccattagtctgacagatcgcctgaacaccattaagaggtgtggcgtttttgctttcatttctcctgctgggagaagtggcggttcatgtgtcattccagtatctcacatactcacacggggcaggggggagggggaaacggggaactatagcaatatttaaagatgctttggaaaccaaccgtgaacacatcaacaccacgacgtctacgattacttgctattggccctcggatacatttaagagaaagagacagtcactcttttttttcttaaatgatatacatataaacagttatttttatcctattataattgtcttttgtctttatctagtactatgtggaaagggtttgcatcatagatttttcccagccttataatataccataagctcctacttccctgcccctccctaatcagtattctttcaagagttctttggtgaagccatctatctgaaactaaaatgaaccaaacccatatttcactggtggttggagaaaaccatggccaaaacgattgtggcaggtctcaatcttgggagtttttaagaaggaatgtgccagaggccgattcccaagaacagagttttcttttgttttgcagaggcattcaatgtgtctagtgcttgctggccacagcagttactaccacagagccttctgggaggggccgttgtgttgaaggaggctcctgcctgagggacagcatcaggcagtgggctctgtagagtgagaaccaggtggaggccttctgtgcccagctcagagttctgcaccacgccaggactgcccaggccaagggctactgacgcaagttccactcattccactctgtggggggcgccttgggcctctcctggaagggctcttggagaaggaattggagttacgtacaagtgacctaaatgggaagcttttctagatgagattggattaaattccatgtgatttctctttccctttaatccaggttgggactcgtttctttctggtggatcacagctgcccagatgttgcaattgatttttatgtttctgtagagaagtatttttctttcatcttcaggattttttttgccaccaaaagaaaacattggaactctgtgtttcctcttgattgtgacttcccagtgttgacagttaagtccttagtgtcgtaggtcccagcccaccaatactatatcaaacactgttatgcacataatgcagcactgtgatctaatttaaataatacttttttattatttatactactatatataatatacatcaacacttttgctatataacctaagtgataaccctcttttagttacctgccaaactctggacttggtttatattgcagttaacacagttacaaagctgtaatggtgtctttttttcctttgtaacggaatgtgtaaatcaaagtatatacattgtgtggtgttcctgtttctggagtttcatgaggatttacacatggcattcagtgttctgtatagatctgcctacctttgtgaattcatctgttaacccctcttcctttgagagagcaccggcgatggtggttaactccttgtgttttctctctctcctactggttattcttgaattaagcacagactcgtcagctcggttgctttatcatgaataatgtgtgtgaccttgcagttcttccacagttcagcaaacaagtgctagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagaaaaaaaaaaaaagtgataaagcaatcagaagaccaagaggtttactattgatgcttagggtcgtctgaccttggctggccaatagacctacacggccaaattaatttacgagagtaataatttttcaaaagccaattttttttctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagttgcatcaattgaagaaaaacaccaaaaa

SEQ ID NO: 148 - DNA, 1701 bp, Homo sapiens
atgacggggaaagcaggggaagcgctgagcaagcccaaatccgagacagtggccaagagtacctcggggggcgccccggccaggtgcactgggttcggcatccaggagatcctgggcttgaacaaggagcccccgagctcccacccgcgggcagcgctcgacggcctggcccccgggcacttgctggcggcgcgctcagtgctcagccccgcgggggtgggcggcatggggcttctggggcccggggggctccctggcttctacacgcagcccaccttcctggaagtgctgtccgacccgcagagcgtccacttgcagccattgggcagagcatcggggccgctggacaccagccagacggccagctcggggtttcggccccaagcgtttcgggcggccgcgcagttctccagtccccgcgtcgggcagggctcggccacggcactctgttggagccccactgaaaactgggtttggggtgtcggagcccgtggtgcagagtcgccggccgtgtcggagggccccagcaccgctgctccactgcggccccggcctggtgatccgcactcctcgagcccgatgctgttccggctccggccccatccctggtgtccaaagttgtctgattcccaaatcccgcgctggtcaactggggtttatttttcacccccacgagctcagacaacccggccatcgcggcagctaaagcggccgccatcctctcccacgccaactttccggcccggggcattggggctggccgcgcagggcagggcgcagcagggtcgcgagcgctgccggggatctctgcggccccctaaggctgcctcgctctccgtcgtcccggtcccaagcgcgccggggcctttgcctctcttacaacgaaatctgttcaaaacctccggattcgggccccggcgcgggagagattctgaagatgtttcctccagcgatcgaaaaatgtccaaatctgctttaaaccagaccaagaaacggaagaagcggcgacacaggacaatctttacctcctaccagctagaggagctggagaaggcattcaacgaagcccactacccagacgtctatgcccgggagatgctggccatgaaaacggagctgccggaagacaggatacaggtctggttccagaaccgtcgagccaagtggaggaagcgggagaagtgctggggccggagcagtgtcatggcggagtatgggctctacggggccatggtgcggcactccatccccctgcccgagtccatcctcaagtcagccaaggatggcatcatggactcctgtgccccgtggctactggttcaagatggctttcccaggcgcttttctaaacccgaataccaacaattctttctagggatgcacaaaaagtcgctggaggcagcagccgagtcggggaggaagcccgagggggaacgccaggccctgcccaagctcgacaagatggagcaggacgagcggggccccgacgctcaggcggccatctcccaggaggaactgagggagaacagcattgcggtgctccgggccaaagctcaggagcacagcaccaaagtgctggggactgtgtctgggccggacagcctggcccggagtaccgagaagccagaggaggaggaggccatggatgaagacaggccggcggagaggctcagtccaccgcagctggaggacatggcttag

SEQ ID NO: 149 - DNA, 3032 bp, Homo sapiens
aacacgattcctctggccaggccaaggggagggcgacactgacaggcgccccccacccaggggccgtggcgaagcaaggggccggctgctcagaaaaggataagaagtggtttctcctcccctcttcccttcctcatcctgcagcccgcgcctcccccctcgccgcgctgcgcacggatggcggcgggagccgcagagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttggctgtgca

SEQ ID NO: 150 - DNA, 5801 bp, Homo sapiens
gagcgagagcgcgaaggaaatctggccgccgccgccgcgagcgctcccgaatttttacttgttcctgcaaagctgctggagctcagaagctgattctatcacattgtaagatgcctttggataattctacagtcctcttaaatgaatctttagaacttggcaagtctcactagataccttcaatcatcattttgagctcaaagaattctgagacttatggttggtcatatagaagagtaccttgaacctatagtttcctgaagaatcagtttaaaagatccaaggagtacaaaaggagaagtacaaatgtctactacaagacgaaaacgtagtatgttatgttgtttaccgtaagctgtagtaaaatgagctcgattgttgacagagatgacagtagtatttttgatgggttggtggaagaagatgacaaggacaaagcgaaaagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaaccccagaatatttaaaatcaaaaaatcagttagaattctgttgtcacatgctgcgaggaacaatagacccaaaggagccatctacctatgaatatgtaaaatttataggaaatttcaaatctttaaacagtgtatcctcttcagcacacaatggttttgaaggaactatacaacgcacacataggccatcttatgaagatagagtttgttttgtagctactgtcaggttagctacacctcagttcatcaaggaaatgtgcactgttgaagaacccaatgaagagtttacatctagacatagtttagaatggaagtttctgtttctagatcacagggcaccacccataatagggtatttgccatttgaagttctgggaacatcaggctatgattactatcatgtggatgacctagaaaatttggcaaaatgtcatgagcacttaatgcaatatgggaaaggcaaatcatgttattataggttcctgactaaggggcaacagtggatttggcttcagactcattattatatcacttaccatcagtggaattcaaggccagagtttattgtttgtactcacactgtagtaagttatgcagaagttagggctgaaagacgacgagaacttggcattgaagagtctcttcctgagacagctgctgacaaaagccaagattctgggtcagataatcgtataaacacagtcagtctcaaggaagcattggaaaggtttgatcacagcccaaccccttctgcctcttctcggagttcaagaaaatcatctcacacggccgtctcagacccttcctcaacaccaaccaagatcccgacggatacgagcactccacccaggcagcatttaccagctcatgagaagatggtgcaaagaaggtcatcatttagtagtcagtccataaattcccagtctgttggttcatcattaacacagccagtgatgtctcaagctacaaatttaccaattccacaaggcatgtcccagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctgggttgaattttggttccgttcaactttcttctggaaattcatctaacatccagcaacttgcacctataaatatgcaaggccaagttgttcctactaaccagattcaaagtggaatgaatactggacacattggcacaactcagcacatgatacaacaacagactttacagagtacatcaactcagagtcaacaaaatgtactgagtgggcacagtcagcaaacatctctacccagtcagacacagagcactcttacagccccactgtataacactatggtgatttctcagcctgcagccggaagcatggtccagattccatctagtatgccacaaaacagcacccagagtgctgcagtaactacattcactcaggacaggcagataagattttctcaaggtcaacaacttgtgaccaaattagtgactgctcctgtagcttgtggggcagtcatggtacctagtactatgcttatgggccaggtggtgactgcatatcctacttttgctacacaacagcaacagtcacagacattgtcagtaacgcagcagcagcagcagcagagctcccaggagcagcagctcacttcagttcagcaaccatctcaggctcagctgacccagccaccgcaacaatttttacagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcatagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaaaacattttgtatgctgcatgaaagcgttatctcttccttacaggtgtgagcacctttcctgaaattctgacaccatgtgcaaactgatccatcctgtttttccttttgtttacaacacagtagtgttctgttcacttttccggggcacaagtttttttgttcatactttggctgtgatgtcacagtttgttcagtgaggtatgatgtgctgctgggaatggattttttttttcaggttaaattattgatacaacaggattttcaagttattcagaaatatccctcatttcattatttttcaattatgtttgaaaataggatttgcactgctttattttaggtggctgggagttttgattgcatattttgttatagttcatagttggaaatatttgcgtaaatggttttcaacaagcctgaaagtaatttcaagaatgtttcagttatagaggtaaaatttgcacacaaaacatcttaggcactttttaacattctcaatcatgggaattttaacttttgggatttgttgaaatcttttttattatccttcacaatttcaatgcttcttttagtcagaaatgattcagggttatttgaggggaaaaaaccccatagtgccttgattttaattcaggtgataactcaccatcttgaagtcattgtccggtttccgtagcagttttgaaaccttagtacctttttaacagcatgtgggtgtcagtgtcattattagtctcctaataagttcctctgaagactgctatcagtctcttggactggaggtacaaataatttagaaataaaagatgataacctaacactatcatagttattaatgtgatcctaaaattgtttcctaaatcagcatttttctttagtcatttaagaatttaccagaaatatttgctcaatatgatcttgatattcctacaaagaaaaaagaaggggtagggatttggctatgccttcactacaacattagaatattgtaactcacatgccttctaaacgtgaactaagatttcctttggcaatatcatattctaaaagtaataaattccaatacaagttacatacatttaaaaaacattttacagattttatggtactaatgaaatttacagtgatagaacaaaagaggattagtagaaaatacattattagaatataaaaaatgttattactgaggaaagggaggagaggacaagtgtaataaatcaaaattgacctcaaaagaaaatgtgtaacagagttgaggttgttaaaacagaaaaggttctgaataatgaagattaacctaatgcagaattgctaggtaaagaggtcaggggaatgctaagccagttcttaagacttctctgtcctctgctttgctgttatccttaaggcatatactttgtctttctgcagaaaattctacctggctacaattactttgaacattaatgttgaaaaagaaaacaaccaaagaaaattggtacttacccttctacaaaagaagtgtgactagatatcaatcagtaattaacatatcaaggagctcttctagctaaatgaccatccagtagagatttcccacattcccatgaatatcaagaatagttgtcagaatatgtatgtacctgagcatatgtacacagacaagggggatgttgtggaatatggcaatagcattgttcttctcccctttcaaattgcctttcttgaccttatgccattccatatatatctgagttgtgcctcatttatttattggcaatacctagtgatacggatttagctaacaaaagatatgaagaactattatattgaggcctgtcctctacataccacacttaaaagatggtgaactgtgagtactacttaggttgacagcaacaaagcataagacaagccccaggtaaacgtctaaactgtttactcacattgtcctactccagccccttcaattatttcccatctccacaaatagtcgggggaaaaaattaaaattttcctttatgattcttactgttcttcgcagctcatcttttcctgcttagaattaaccattgctaatttaaaggagcagctagctgcttttctgtcagtctgaagcgtagtagtggaagaggtagtaagcaccagctgcctctttgctgctttgttttcctcctgattctcttaaatttgggttgcaaagctatcccgccccccaccctgccccatgaaacttgagcattcaaatgaagattcagcagtgtctgttcttcatttctatagccaaagctgttagttaaaatcccaaatctatagcatttaaagataccaaatagaaacaccttccagcttt

SEQ ID NO: 151 - DNA, 2855 bp, Homo sapiens
gaggaggggaggcctcctccgccgccgccatcttggaccgggcccggtcagcttccgcggagccatcggcagacgccgcggcctcccttgagccccgacccccgtcgtcagaacaaccccgggcccactcccccaaccccacttccgcttcgcgccgctatcgcgatagcgcccgggcccggggcgcgagaaaaaggcggcgggcgctcgcctcccccgcctgtcgcgatacgctcctcagcggcggcgccagctcctgtgcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggtggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatgacggctggc

SEQ ID NO: 152 - DNA, 3333 bp, Homo sapiens
cggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagagccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacggccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagcaaacagaaacctggttataacctgacgctaaaactaaaaacaaggaaatgtacctctttcttcagaattaaaactaaaatcttaaataaaacagaaaacttgatgatgaaaaaaaaaaaaaaaaaaa

SEQ ID NO: 153 - DNA, 2550 bp, Homo sapiens
ggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcaaaaaaaaaaaaaaaaaaaaaaaaaaaaaaaaaaaaaaaaaaaaaaaaaaaaaaaaaaaaaaaaaaaa

SEQ ID NO: 154 - DNA, 4679 bp, Homo sapiens
gagccaggcgggggcggagggggaggctggcagcggagctttgaatagggaagttttgcaggggttacgtttgcagtcagtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttcttttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagcatcttgagtctggttgttttttttgggggaagggggttgttggaacagattcctcctgcattcatcaccctggcttcctcctgggggcaaatcttcattgagcaaccctgagaacaactcaccgacctcagccccttcctctttccacagcctgtcctgggagctggagaggatgtcagcgagcctgacattgccctccctgaatgcatcaaatactcttctccaaggactgacaaaaacaaccccccggctgtgggcacagtagggaaccatgccggtttgatcttccattgctcaagccagggaatgcattgcagaggcacctgcacaacgacaaacttgagtgtttccctgccacttctgtgcctccacagcctgctccagttccgcagctagagctgggcctaccttccccagccagccctgccacacacctggctgaggcatgtctgggaggggtggaggaggcagagggactccaggccagagggctgttctcacaacctcagcccactctcagtcaaggagggcagaaaataaaagatgacatcactgccaaaaaaaaaaaaaaaaaa

SEQ ID NO: 155 - DNA, 1510 bp, Homo sapiens
gactataccactcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaaaaaaaaaaaaaaaaaaaaaa

SEQ ID NO: 156 - DNA, 1620 bp, Homo sapiens
cattgtcttgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccagatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 157 - DNA, 9752 bp, Homo sapiens
tgtttccgtgcgcggccgctgcgcactcggcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaataaaaaaaatgtctcatttgggaaggaaattccttttaaaaaagagttgagacacttagaaaactaatgttttatatttagtcaagagttatttaagaaagtcaagcttgtttaacaacaaaatatgaagatttaagtgttaattgctggatccattttaaaataagattttaattaacatttgtaaatggtatattttcgtttgtaacaaaccattgtcttttttcaaggatgaacagagtttatgaaggagcatcattctaagaattaagtgatgtagtctttatgtttggacagttcaccagattctcaagaaggctttcaaacaactataaagtttgatgtttgtcctgctgagctaatggggaaagttatagcataaaaattgtgtaaccgcatagatatgtcatttttaaaaactggtttaacagaaatcaagcaaagtcacaaatatgttcacaagttggaattatttattgagtcaaaatgtcgaatcgaacattttgaatgaagtaagtgttataaatgaaaaattgcctgatgtttagcagtttgtattctctaaagctttttttcaaaagttcaggctttctacttactgggaagttggtggtcctcttagtccctgataaatcaaggcaatcacattcatgtgagctggatgaatttataagttataaagaccttatccttcataccttgaggatgattgcactggttttgaagtcagttgcttaatgatgaggtgagaaatgtatcctgttgctaaatctgtcttagacccttggtgaaacttgaagatttcagtttataaagataaaatcaagcatcttttgtgcagttttctttttttaatgcaagaatggtggggaggtttgtttgtaagcatgaaactttgagaatctttattaagaaaatgacataatttttaaaaaccttgtagccaagaacatatgtggccacattaccagtaataaatgtttttctctttatattggccaaaagggaataaaaatgtcatcataggaatttgtacatatgctactgatttgcctagaaaatagcaagtttgatattgctcactttgcaaatatagggccatgtggcacttttatctataggacagattaataaaaatgaagtggggaggggtttatttttgatatattactcttatgagttttcaagctttgataatgtttaactgaaaagtggcttagaaagggctagatccaatgtgttcattattaaataattgctatcagatacaattttaagttcattctttttcaaactcaagtaccatattggcaaccataatattgtcataggtgctctcttcatttagatattcttggggggggtggcatttgtataatatatgtgtacatatatatatatatatatatatatacatacagtatataatctaaagctctgagagctcttaagtcaggaatgctgagtattatagtatattgaggtcagatgaaattttacatttttgtgtgttctgttgcattccttctggtagtttctatgactgcattactccagcactcatgattgattttatcttctaattttcttccaagtattttattttttattagttttctttggcttgatacttttaaatatgttactagtcacttgaaagcctctcccccaaaagtatttggtttgtatgctttgtctgtggcagctataacagtggtaagaacattttgaagatagctttttaaaggaaccactgattttttcaaaaatcatcctgggggaggaattttggcatttcatttgagcagggattttgtcagaaaatgtgttttgatggtaggtcagcagcagtgctagtctctgaaagcacaataccagtcaggcagcctatcccatcagatgtcatctggctgaagtttatctctgtctctcaggataaatccctgtaggacaaatccctactatcatttctaccttttggggtgacatgtggaatcatacaaaggcttaggaagaaatacgtttgtttaaaccaggatgctttacttacttgaagtgacttcaatctagatttcttttaatatttaacaaatttttaattctatgatcagccacagtcagctattaccataaattggtctctgtttattttgaagatcacggctgcttcattttgcaggattaagtagggctaatgtatcttaaagttaagatcttgaattaaagtgagttttagaaatagtgttacataccttttcagttgttttcaagaggctttatttttgttgcctttgtagccctgaaagctgttggtatattttttccctcatggacccaatagaaaagttgtatatttatttggattatatttacattctgtcctttgtaaatgtttggtgtaacttgcacttttttaaatgacccagtttgggtattagcaacttaagaaattccctcatcaagtaattctcaactttttagtctttctcctctcttcaaatcatgtgactttttaaatggaagtttttcattgattaaaatattttagcacctaaaagctagccttaaaaacagctgtaaaagaaaaacatcaggaaattagatatgactagcccagttaattaaaagacgggctcaaaccttgttttattctttttcatcttggatgaagattgaagggaaaataactcaagtgcataatatttattttcaatttttaatgagactttatcctcatcacaacattaatactgtacatagtatgccaaaatatccattaatttgtctagaatagtacaagactttttaaagcaattgtcctcacagagaccacatgtaatatactgaaatatgttcatttttaatggctttgttaacatcaaagaaatgctgcctaaatttgatttcagatgaggaaggagaaagtaaagtgtgcatagtaaggctgtaggtgaagagttgtgagataaatagttcactcagttgtacaaagcacaactagaactttttgttgggaggcttacatacatcttgaatattcttaatgtaataatgttgactattaagttggctacacagtcactgtatgtactaggaactggtttccttgacattctagaatcaatggctaggagaggcattaatctttgaggggctgaacatatcatgaagctgagtcagtatggaaaattttcaaataaacagggtgctgaagttccatctgtctcatctgcttatgataagttcttattgattagtgaatgtagcttaagcctttgtatgtgtcctcagggggcagaccgactttaagagggaccagataacgtttgaatggagggattatatttcaggtgttttagcttgaaatttattttttaaaaaaagaaaaatttaaaaaatatataaataaaatagaacaaagccggtgatgcaagttgatattataaacaggcagttttagcacagaaagaaaatactgacctgtctgcattctggtacggtgggtgcaggtcccagctgggtatgacatgatacatttttaattattctcaccagcaagtaaaaggaaaatgaacaatcttttggaattgtctttgaaaaggatcaaagagtaggaaattcacatttgacctaacattacttgcctatagaagtatggcatttccaagcttttgtctgaggagcatctcagagaagtgagagtaaatctgagttagcttaaaaattggtagggaggaagaaaatctctgcaaataatgattttatgtttgttggccaagtgaaatgatctatcattgtgtttgggaggttttattttcttatgtttttaaaattggtaaatgctttatagatgtatttttatccaagtgccactccaatttgtgtatgtaataaaattatttatattaaaagtgggaaataattgtcaacattttttttgagtatagatttattaggggtggcaaagaagagtgctagttagcagttttccatgtaaagttgtccttgactgatttgtccacatgtcagttgtaactcccccactccctgcaaaaggaattatttctaacccagatgtatcacttgaaactttttagaagcaaaataatcagggaagttcctagaaaggtgtttggctttttggtttttgagggttggggtaaagaagacttcccccacaactgtcagcacaaaacagggtattgatttttaactctgatgtttctattggagttgaatactaaataaataactataatgagggaaatacatttctaataaaattccctacattctagaaacatccctgttttaatttttttatctaaatctttttgtgctttatgtgtaaagaaaaaaatgtactgagttacaatgcattttattaacactatgtacataatagctgctttgtgttcagaatagtagcagttgctttgtatattaaagtgatccttgtgaatttgtgaaatattgtcataaagtgctttttcttactgtaatctttgtggtatcaactgtcataatgctctttttacacaaacatttatgtgcagtcacataaacatgcttttaaaaactctgtaagtctcttttttggggatgggatctctatattttgttgggttttttttgctagtagtgtgaagccatgttttattggacttaaagttacaatatattacaagcttgtgttggaaggcagcaaaactaattcagacaacaacatgtcttcagttactggatccctaattttcaggacaaaacctgtttttcaataagattgaacagtgcctatttgtggatttggagatgttactgtcaagatgactaatggagacatacgaccagctgtgtctgatgtcataaaacacgtgttcactgaaaggacaataagactatataccttctcaggtccccttgcaattctaaaactctgtgatcatataaattggaaggaaaggggaggggatatggttaatctttgcttaagctgtaagaataaaaaagttatctcctatactattaacttctgaaataagttctgagacgagacatctgaaaataagcagctgcattatttgtatgtttcttcactgccaagatgtgttcaagcctgctatacctgccattgtattggaaggcttaatgaatttcatttattttctgcaacaacgattacagaatttattgcacaaaatgagacattttgagagtgatattaattacatgagggacaataggcatgaactaggattgttctaagcaaatcggaatcgggtcaccctgccacgttcaggtgcttggaccttcaggaaaagattgcccatcttgtcatttgaccaggcactgaagtgacaagaccatccttgagaagtcacatccaaagataaaattctgatccatttctagttttagtgtttcgccactgaagacttaacatatgtcttttacactcaggttgcaaaacacaggcccaagacaaacttaacttctcccccaaatcttccttccgctggtttttccatctcgtaagtggtgccactatccatctgttaaattgtttaggggaaacctagaaaagcactaccttaatcagtgttatccttcttcttaactgtgcgtcctaatttctccacatctttcttaagtgcagtgaccaaaccggatgagaattctaacacgggcctgacatcaaatggaaaggaaggataatgtccaggagttggaatgttatccttgtttttaattaagatgcaattcacataaattaactttttaagtgaacaattaagtggtagtacatccacaatggtgtacaaccaccacttctatctagctccaaaacattctcatcactccaaaagtaaagtcccgttactctccattttctcctcccaccgcccttgtccctggcaaccaccaatctgcttcctgtttctttggatttacatccgggtatttcatgtgagactcatacactgtgtattacttctttcgtctagctttaatgtgttgttgaggttgatccattgtaacatgttatcactacttcattcctttttatagctaagtatactttttatagtaagtatgccattgtagatatataccacaagtttatcgattcatccagttgagttgtttctactgtttggctaatgttcatagtgctgttatgaatgttcgtgtacaagtatttgagtccgtgttttcaattatttggggtatatgcctgggagtggagttgctgggtcatgttgaaatcgcacatttaactttttgaggaactgtcaaactttccctcagcagctgtaccgttttaccttccaccattgatgtatgagggttccaatttctccacaccttcaccaacacttattttgccattttaaaaattatagccatcctcatgggtgtggtctctcattgtggttttgatttgcatttccctgattactaatgatgtggagcatcttttgttgtctttggccatctgcgtatcttctttgaagaaatgtctgttgaggtcctttgttcattgaaattttgttgttgggttctgagttccttatatattctgggtactaggcccttataatattttcgcctataagtttttgctttataatgtcctcattgttttcaaacttactttatgtaatatgtacacttctaaaaaaaagaaacatggaaaagggcaaactgtaaaaaaaaaaaaaaaaa

SEQ ID NO: 158 - DNA, 1888 bp, Homo sapiens
gtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattatttgcagtgggaaaaaaaaaaaaaaaaaaaaaaaaaaaaaaaaaaaaaa

SEQ ID NO: 159 - DNA, 2702 bp, Homo sapiens
agaagacgtgcggagggagacgcagagacagaggagaggccggcagccacccagtctcgggggagcacttagctcccccgccccggctcccaccctgtccggggggctcctgaagccctcagccccaaccccgggctccccatggaagccagctgtgccccaggaggagcaggaggaggtggagtcggctgaatgcccacggtgcgcccggggcccctgagcccatcccgctcctagccgctgccctaaggcccccgcgcgccccgcgccccccacccggggccgcgccgcctccgtccgcccctcccccggggcttcgccccggacctgccccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaaaaaaaaaaaaaaaaagatgcagcatcaaaaaaaaaaaaaaaaaaaaaaaaaaaaaaaaa

SEQ ID NO: 160 - DNA, 7455 bp, Homo sapiens
ctgggtcctggagcagagccgaggagccctggggtccctcaaagtttgtgtctggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataagatttctgctcaggaaagtaggagaaagaagaaagaatacatggacagcctggagaaaaaagtggagtcttgttcaactgagaacttggagcttcggaagaaggtagaggttctagagaacactaataggactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctggtcagcgccaaactggaggggaatgaaacactaaaagttgtagaactcgacagaagagtgaacaccactttctaaagaggctgcctgcaccccctccctttcccttaactctacttttacatccccaaaccacctttgtcatcagcttttcctctttgccactggatcttcatggagacatgggcaagcattagtggcttcagattggagaccagcctgggacttccctgcagtgagagagcatctccccctggtccatgcccctcctgtgcagaagggagcctgcatccctcccttcctttctcttactgccataggaaattattttaggggttggaggtgggacaagcaggcttgtttccaccaatagtgccaaaaagatattgcctaatgtgcacctgtgaggtgtaaccccccgctttggagacgagatggctcttgttcagtcaagaccccagactctggccacaaaaatgccataatgcctgttggtatttggcaaagcactgacccgtgtcctccgttgctcgcactggggtctctggtgtgaacacccccgacagcagccctccgcccactctgccccctgggagccctcgctggatcgtctcgtctcctgcagcagcactggcaggcgagggctctcgttcatattctcaggccgcaagtgcaatgcctgaggggatcaggcttttctactccaggcaaacctgccccatcttgtcgcttttaggacctcccacaacctggttccccacacatccatagttctgcctccccagcttctcctccccagttgtaaatagtatttattagcttgccgaggcttcctgctagcaaccacactgaagagatcgatgcctcctttcaagctagccaagttttctgcgagccttcagagctaggagggcaccctaggctctgggatcccgtgtctttccagacaatgttttgtttcctttcctttgttttttcttttaactggaataattaccattgaaaaagaagttcctttgagcatgtatgtgtctgcctctaggatgagctcagagcgagagatgacacaatgcctcactcaggccccgggctccctggccacaagctttttctatcctgttttcatgacagagaaggggaagccctgttctgacaacagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccatccttccaaaacggaatctatgtagacaatgggacgttaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaatagttaatggatgtgtgcacattttctgttcagggattaagaccagaatatcagtggatttgttttccccaccaagtggcctcttagactagtcattaacttatgattagctctaaagatttcaaatagtggcagacagtgtcttctgaatgtaagttttgagaaatacgagtctgtcagagcggccataagccataaagagtcaatctcttaattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggagagagtaggtggtggtgacgtgagggctgtgaaggatccagagacaagacttagatgtttcgttcattcactcactcattcagttactcctaagacttttcagtttcataaggaagagtgttgcctgaggccctagggaatattggggaatagaagggattgaggaaacattaataatagttattcaaaagacccaaatgcttatacttctctctcccttcttctctctctgacacacacacacacacacacacacacacacacacacacgtgcacattcctcccttacatgctcatttgtgccttaaatgtgccttataggtaaatccaggatgactgaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaaagctttgtaggacacttgtacttagtttgggaaaaaaaaataaattgaaattgttatgcttttgtatttccatttcttgcaaataaatattttttcttaaatagtaa

SEQ ID NO: 161 - DNA, 2586 bp, Homo sapiens
acagagccacagagggctgtgagcttgcccagccccaggtaacgctggcggtgggtgggcctccagcttggagcagagaccccccgaggcatctgcagacagaactggatggacccatgaatacggatttagctgctggaaagatggcttctgctgcctgctccatggaccccatcgacagctttgagctcctggatctcctgtttgaccggcaggacggcatcctgagacacgtggagctgggcgagggctggggtcacgtcaaggaccagcaggtcctgccaaaccccgactctgacgacttcctcagctccatcctgggctctggagactcactgcccagctccccactctggtcccccgaaggcagtgatagtggcatctccgaagacctcccctccgacccccaggacacccctccacgcagcggaccagccacctcccccgccggctgccatcctgcccagcctggcaaggggccctgcctctcctatcatcctggcaactcttgctccaccacaaccccagggccagtgatccaagtacctgaagcctctgtgaccatagacctggaaatgtggagcccaggaggaaggatctgtgctgagaagccggctgatccggtggacctgtccccacgatgcaatctcaccgtgaaagacctcctcctttcgggcagcagtggggacctgcaacagcatcacctgggggcctcctacctcctgcgacctggggctgggcactgtcaggagctggtgctcaccgaggatgagaagaagctgctggctaaagaaggcatcaccctgcccactcagctgcccctcactaagtacgaggagcgagtgctgaaaaaaatccgccggaaaatccggaacaagcagtcggcgcaagaaagcaggaagaagaagaaggaatatatcgatggcctggagactcggatgtcagcttgcactgctcagaatcaggagttacagaggaaagtcttgcatctcgagaagcaaaacctgtccctcttggagcaactgaagaaactccaggccattgtggtgcagtccaccagcaagtcagcccagacaggcacctgtgtcgcagtcctgttgctgtcctttgccctcatcatcctcccctccatcagcccttttggccccaacaaaaccgagagccctggggactttgcgcctgtacgagtgttctccagaactttgcacaacgatgctgcctcccgcgtggctgctgatgctgtgccaggctccgaggccccaggaccccgacccgaggctgacacaacccgagaagagtctccaggaagccccggggcagactggggcttccaggacaccgcgaacctgaccaattcgacggaggagctggacaacgccaccctggtcctgaggaatgcaacagaggggctgggccaggtcgccctgctggactgggtggcgcctgggccgagcactggctcaggacgtgcagggctggaggcggcgggagacgagctgtgagccccgccaggactatgctcccaggcccctctgcccaggggtgccttggggatgctgcactgggcagctacccacctggggatgggacgtgaggccaagaccccagcagagatgccagaatgggggaggcacagctcatagccacacacccagggcctgactgaggcccacgcaggaaccgacactcagacacaaggcaaagagggccacaggacccgggaaatacacacagagccaggagcagaagcaaagagcagacacacatacagcctgaaacagacctggacagacagacacagcctgaaacagacccggacagacagacacagcctgaaacagacccagacaaacagacagacagacacagcctgaaacagacccagacagacagacagacagcctgaaacagacccagacacagcctgaaacagatccggacagacagacagaaacagcctgaaacagacccagacagacagacagacacagcctgaaacagacccggacagacagacagacacagcctgaaacagacccggacagacagacagacacagcctgaaacagacccggacagacagacagacacagcctgaaacagacctagacagacagacacagattgaaacagacccagacaaacagacagacacagcctgaaacagacccagacacagcctgaaacagacccggacagacagacagacacagcctgaaacagacccagacagacagacagacacagcctgaaacagacccagacagacagaccgacgcagcctgaaagagacccagacagagagacaggcagacacagcctaaaacagacctggacagacaggcagacgtagtctgaaacagacctgaacagacagacagacgcacacacacaacagatgcgcagcaactccccgcccagggacccctcccggcctccctcgcacactgggaggaggaagccgccgagactgcagggagcctggccccggagccccgggtgcgccctggtctttggagcagccacggcccacaatcaccccccttttctaagactgcctgatccgaaataaagtattttgacaaa

SEQ ID NO: 162 - DNA, 1747 bp, Homo sapiens
ccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaaggtggcatccacttttgtagtaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctg

SEQ ID NO: 163 - DNA, 8213 bp, Homo sapiens
ttttagtggtggagtcaatttatttctgagacgatctcatttacctgaatgaggagctcatatttattttcaggatttatgaggaatccaagatgaatttggagcaggagaggccgtttgtctgcagtgccccaggctgctcccagcgcttcccaacagaggaccatctgatgattcataggcacaaacatgaaatgactttgaagtttccttcaataaaaacagacaatatgttatcagatcaaactccgaccccaacgagattcctgaagaactgcgaggaggtgggcctcttcagcgagctggactgctccctggagcacgagttcaggaaggctcaggaagaggagagcagcaagcggaatatctcgatgcataatgcagttggtggggccatgacggggcccggaactcaccagcttagcagcgctcggctgcccaaccatgacaccaacgttgtgattcagcaagccatgccgtcgcctcagtccagctctgtcatcactcaggcaccttccaccaaccgccagatcgggcctgtcccaggctctctatcttctctgctacatctccacaacagacagagacagcccatgccagcctccatgcctgggaccctgcccaaccctacaatgccaggatcttccgccgtcttgatgccaatggagcgacaaatgtcagtgaactccagcatcatggggatgcaaggtccaaatctcagcaacccctgtgcttctccccaggtccagccaatgcattcagaagccaaaatgaggttgaaggctgcattgactcaccaccctgctgccatgtcaaatgggaacatgaacaccatgggacacatgatggagatgatgggctcccggcaggaccagacgccacaccatcacatgcactcgcacccgcatcagcaccagacactgccaccccatcacccttacccacaccagcaccagcacccagcacaccatcctcaccctcaaccccatcaccagcagaaccatccacatcaccactcccattcccaccttcatgcacacccagcacatcaccagacctcgccacatccgcccctgcacaccggcaaccaagcacaggtttcaccagcaacacaacagatgcagccaacccagacaatacagccaccccagcccacaggggggcgccggcgaagggtggtagacgaggatccggacgagaggcggcggaaatttctggaacggaaccgggcagctgccacccgctgcagacagaagaggaaggtctgggtgatgtcattggaaaagaaagcagaagaactcacccagacaaacatgcagcttcagaatgaagtgtctatgttgaaaaatgaggtggcccagctgaaacagttgttgttaacacataaagactgcccaataacagccatgcagaaagaatcacaaggatatctaagtccagagagtagccctcctgctagtcctgtcccagcttgctcccagcaacaagtcatccagcataataccatcactacttcctcatcggtcagcgaggtggtaggaagctccaccctcagccagctcaccactcacagaacagacctgaatccgattctttaaaatgcaccatcagacctggcctccaagaagagctgtagcgtaccatgcgtcctttcttttaagggcatttttagaattaactcagacctggaagactcctcagttcttcaaagactggctttcatttttatagttattatggaaatgttgtcttttatacttagttatataagaaaaaagggagttatgcaattaatatctatcagcttgggaaacgctttggtgcttttctccagttttctggtaccagttacttgtttataaactgaaccttttctgtatatagccatggtttcattcttatcagtccaaccctttgcctgaaacattgaatcttgttaaaccacagcttttagctaaaatgaggtatacctagatgtcaagtaagacagatccaaggtaactgggtaggaaatcttttgacatcttaactcatgttgagtttgtgctgtggtgtcaccagaattccagataaacacacagcctttcccatacctttttttttcttactataaaatattataagatccattgatgtccaaataataccaccaagcatctcttcacctctcctcctcttggtccacttgctaatgcccagttttcttctccatttccactttttcttaggctccctatttactattcattttgacttccttctgttttatttttttccctttagcattgcatgtgaataagaaaataatgtttaaagaaaaaaaaaaaaaagcaaacctccaaaacgtggacctaaccattgcttcacttacacttcacccacagctggagttcattcaactcttgcttttcacaaaatagtaaccaggagatgtttaatgtgcctgatttaatgtttttaataatcacagcaaatgaaaggtggtttagttataagtgaagcatggttgaataccagctggggagacactagggaagggagctttgtaagccttgattgcgaaagtccaaattttgatgtggggctataacatgacacccttggattgcgactggttttatacggcctgcctataacgttgaaaatccatgtactacataataattcagaagggctctattcactacacagattacattgttcaatcatcagctgctaatagcctaagatttatttttttttttttcttaagcctatggaaccggctttgctgttctggggggtgaaaatagactaactactggagaaacaaagagagaaagaaaacccagtgtttccataggggcacttttagccttcccacaacagttaagcactctttgactgctgaaggaaccccatggatgaggtgcaggctacttcactctttttttttcttttttgagacagagtctcacctattgcccagactgaagtgcagtggtgcgatcatggatcactgcagcagcatcctccgagttcaagctatccttccacctccgcctcctgagtagctgggaccacaggttcacataaccatgcctggctaatttatttttacttttattttaaaataaaagatgaggtctgtcttatgttgcccaggctggtctcaaactatcctacttcttcctcccaaagtgttgggattataggtgtgagccactgcacccagcctacttcactcttctgaattattctgatttattttcaacaacttttgtgaacttgcccgtgatacaaagcagatagtccctgaaccacagtcgtgcctccttgaaacaagccattctactgtgctaatgttttaatatcacatctcacaaataacaggggtgaatgtttctctctagcaatctaggcaggtgctggtgtttcatctccatttgaatgcttgacctcttaatgtgtgtgtgtgtgtgtgtgtgtgtgtgtgtgttcatgggttttaaaagaacagtattttacaaaaggtgtagcttttataagagtgcagaaaagggaaggatgtgtttttttctctcactatagtataagaatctattttggagaaaaaaagaaaatatgagggtctcgaagcatgatttttatataactagtttcagttttatctaataacttactttttaaatcaatatttatcaacaatctttccttgtatgcagtgctttcaaaagatggttttgagtgtccagtgaaacttatgacttggatatatggttgaagaatcaaaacaaaagcaaaaaaaaaaagcaaaaaaagaaaagagaaaaaaagaaaaaatgcaaatggaataattttctattatattttagacaaacatatcattttcgagtattttaaatactgaattcatagttgttgttttttaaattccaacagtaacagctgaatggtttaatctgactggcttcctaagaaatgtttaagactcagctttaaaaagaagttaacattcatatctctgttttgaaatcaaaaatcatatttcaaaattctttcctaggaccatctatgtgtctcccctcccctccacaaaaaggagaaagagtgcattaaaatgtttagttgggttttttaatttttaatttttatgttatgttttgctttgttttaagtaaacaaaaatttttctttctttactgcatgcatagcacttaataaaatggatttttaaaaaatccactagtaatatcagaatgtccagggagtgactgtcactacaatgatggtttagtttacttctgttccaccttttgattgaaatatttagttgttaggctgaaagcctcggcagttaagaacttgcctgagttttcttcgttcagcaacttgacagtttgactgatgtgcattatatatagctcaattatgtctgttttttatgctaagtaggaaaaccaaccacacacattagcaaaccggcctcaacatataattagaataaactgtcttcttgttctactcagggcctttaggtgtgttcattcacggtatggaaatacagtaaatgaaagattccaactagttgtcagtgcttcttgaaattccaaacagaaagatacattggtcaaatccaacacttggcttatcaatattaagtcttttacctaaaggcccagccgtcaccagacaacagaataatcaatctgcctgaaaatccctcctccttgtcctacactttttgcctgtttgggagaatatctttgtactccattctcctccctcagccagttactgggtcacccatccatgtgttcatgaatcaatcatcacggcctgcagagcacctgtcctaaggagggaaaatcctgtcacactgcctctccccattcgtgtgtggttttcttgatcggtgagatctgtctctgaagtcactgccagcctccctgggaacgtctatagtgcctcccctgccttatgtgatgggagttaacaactcagataagtacacctgagagcatttctatcaggtaaactgtcacttaaatggaggtgtccacatcttaattgtttctccttgacacatttctcaatccacgaagccaggagaggtagagtgaaaatcccagccatggatgaatgtactaatttgaaagccaagtgttaagtcggatgttttcccgttacactactactcagccctctcctgcggccacatcaacggatgcaagtcacagtcttaacacagcctgtgggagacaagcagtttgtgtgctcacagtatatattatagtaattagggtgacttagagcaaatactcttcagatcctatgtagtcagtgaaacaaaatggagagcgtattctgatagaaggacgtcgacggtgaatgttctggtggttgttgcctgttaagtaaactttagtgtgtaagttgagtttgtcattaaaatcataaaccagctgcggtaacagacaagcctttggctggggagttttaagcctcggtaactgctataaaactagccatccagttaggatagaatgtgtttctttctggttaaaaaaaggaaaaaccatctaagaaaatatatatgtatgtatgtgtgtatacagtggaattcaaaggaccaaagcaaaatttgaacaggaatctattaatttagaattttataagatatttattaataaatgttatttttaaacattccatttgaacagtattctgtaggatctacttgtttttaaagtgttagtccataataaactactatagttatgtgtattttcatttttcagggtttcaaatggctattctccatcatttggtggaaatgtttgcttagatctctgtgcatagacatttcaaggatttttattgctctgtgagttattttttaatcaacattctgaacagttttttttaaacatttatttctgtgtgttcatttttaaagtaagctctttcatttaggaagcagagttcagctaaagggaatcagtaactctaactggaacagctttcttgtagaagtgtaaaaacagcttcatctctgcctctctccaccccaccccaatttcctagaaagccttgcactattcagctcccttagtgctttttgtcccttcccgaacaatatgcagtagctttaagccattcaagctccattatgcagtatatctgagaagggaaaggaaacaacccatttaaatttgaataaaaccgtgcctatgcgaacagtagcaatttagaatctcttttctgcttttaaaataatttatatttaaaaattgcactttagctttttgatccctttgtatttctcttattctctttctaacctcttctctgtcctcaaacttgcctttgctctcctttacaataccccccacccctcctccaaggctctgagcggcatcatttaaaatactttacagatatttgcaccaggtacatttatgtgcgtccattggtagcacagctgagacctgtgtctcacatcagcctaggtgaagcctactacaagaatgccaaggagaagagccagtacactatatggtttatactctttatccctttattcatagcatgttttttaaaaatgttatattatgcaacagatgtgaggcagcagctaagctatacttaagaattttctctcaccttccaaaccaaagtgtcctgaataagccaggagacttattcttttgtgcaccctggtgcacatctgactgttgtcctagccatagactctctgaggccactgaaagaacagtggccctatcgatttcattcctaggtctcaaaaatacaatgttgccttgtaacataattagggacagcacctctatttcacaattataatctaaggtaggataagacgacacagcagcaataaacttacaagtaaaattcaataccaaaacaaacacaaagaaatttaaaaaacaaaaaacctagctcatcatgttgtgaaaatgaaaaagtgaatgtccattcaaaatattttactatttcttgtggagtttttcagtgatgtaatgcttgtagccaaattgcttaaagagtgtttatatatttttttccttataaattgtctattttttaaaaaagctatttaaccacagctgaagtggggggtaaggccaaattgccaacacttgttaaaagattaatactcttaagtggcactctgatacctttccaacttgtcatcagaaaggaatcaataattaccaactgttgtatttagaccaacttacaatatctagctcattagaagccaggatctagaaagctccttctaagccatttaagatattcttacattgagcttcatattatagaactttataggattggatattttacaatagaataatttagcctcaggactgagaatgtggaagctgaataaattagctttaaatacatcattaaaatcttatgcacaataagctcattagattctagttttctcctttagaataccaatgccacagacactacaggagataatgaaaggtatcagttgtgttgagtggagggagtttaagagaaaggacccttcccaaccagcagccagtagaaaatacaacctactcacctttttcccttctaagttctgctaaatcacatctgcctcatagagaaaggaatgttgcctttgagaactgtcttggagaacagataagcttgaaatgttctctctagagaggacatagggtttgggatcctctgaaaaggcccagaaaaatagctcagttcaaatacaatgttctaggacaattggaatataaatattgtccaaaaatataattaaaagaaaaaagtttagcactgtgtaaagtaagtgttaactgaggaagtcccaaaaaggtgctgtcactttaagttctggacttggggttctttgtatttgtaaacagcaaagcatttgtgtttgtttgtctatttgtaaagcaaccaccttccttattggaaggagaaaaaaaggggtacatacatgtaaatacttgctgcagcatttaatatgtttaattttgtgttaagctttttgttgcatcgtgaacacatttattgttaccaatggacaatgagttcattaagactgttcaactaggtcagatttttacatctctttctagcaagaagagacaagattttgtgcatttgtacaaatgttaatatcactgcaattccaatataataaagcactcaaatgcaaataa

SEQ ID NO: 164 - DNA, 10197 bp, Homo sapiens
ctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcgactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaagttggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaa

SEQ ID NO: 165 - DNA, 2622 bp, Homo sapiens
aaccgtctcctggttggggggtgggggggaaagatggcggagctgatgctgctcagcgagattgctgacccgacgcgtttcttcaccgacaacctgcttagcccggaggactggggtctgcagaacagcaccttgtattctggcctagatgaagtggccgaggagcagacgcagctcttccgttgcccggagcaggatgtcccgtttgacggcagctccctggacgtggggatggatgtcagcccctctgagcccccatgggaactcctgccgatcttcccagatcttcaggtgaagtctgagccatcttccccctgctcttcctcctccctcagctccgagtcatcgcgtctctccacagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaagccgccactgcagcccaaacctgtagtgctaaccactgtcccaatgccatccagagctgtgcctcccagcaccacagtccttctgcagtccctcgtccagccacccccagtgtccccagttgtcctcatccagggtgctattcgagtccagcctgaagggccggctccctctctaccacggcctgagaggaagagcatcgttcccgctcctatgcctggaaactcctgcccgcctgaagtggatgcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaaaacagcgagctcaagttagggtctggaaacaggaaggtggtctgcatcatggtcttccttctcttcattgccttcaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgccggcacttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaagggaccacctgctgctcccagccatcagccacaacaagacctcccggcccaagatgtccctggtgatgcctgccatggcccccaatgagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagctagttactgggagtaagggagggtggggtgggggggagttcaggtttatgtgtgtgcatttcttttttattattattaaataaacaacttggagggagttgaaaaaaaa

SEQ ID NO: 166 - DNA, 3748 bp, Homo sapiens
cgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatgtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttctattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttaccttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacatt

SEQ ID NO: 167 - DNA, 2048 bp, Homo sapiens
ggcggggcctgggcgcgccgagctccggctgggtccctgcaggtcttggggcccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcagtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcacgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgaaacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatgaaaaaaaaaaaaaaaaaaaaaaaaa

SEQ ID NO: 168 - DNA, 1308 bp, Homo sapiens
gctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattcaaaaaaaaaaaaaaaaaaaaaaaaaaaaaaaaaaaaaaaaaaaaaaaaaaaa

SEQ ID NO: 169 - DNA, 480 bp, Homo sapiens
agcgctgggctaggggcgcggcttgaactcgcctaaagagctgcgccctctcatctcgcgcctgcagcccgtgccgccccagccgctgccgcctgcaccggacccggagccgtcatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaa

SEQ ID NO: 170 - DNA, 1236 bp, Homo sapiens
gctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcagaaaaaaaaaaaaaaaaaaaaaaaaaaaaaa

SEQ ID NO: 171 - DNA, 879 bp, Homo sapiens
ctcctcacagaagcctggagctgggcatccaagaagaagcagcctcatttgttttctggtgtcatcgtaggtggccacctatggcttttgggaatgtaaaaagggcagctctctggcatgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattg

SEQ ID NO: 172 - DNA, 1404 bp, Homo sapiens
gagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctggtgaccttgggaaaggtgttgaaagtgatcgtcgtcatgcggagcctgttcattgatcgaacaatagtaaagggatataacgagaatgtctacacagaagatggcaagcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctgaaaaaaaaaaaaaaaaaaaa

SEQ ID NO: 173 - DNA, 1116 bp, Homo sapiens
gacagagtcggtggcttcttcccggaggagaccggaagttggtttcggctgcagaggggaaggcggctaccagtgtaaagccagagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatgtttctttttctttttttccttttgataatagcatcatatattagttcattttcttttggacagtcttaagagaagtttcactaaaaatgtaaacagctttaatcttgactccaaatttttcaattatgagatgtcataggcagtaatttcgctgtataacaagcatagacaaatgagtgtccctgcactaagaagaatcactttaaaaagcaaagtgttagctgctgttgtatgggacattcctatgttttagagttgcagtaaaactttgatgataacctcaaaaaaaaaaaaaaaaaa

SEQ ID NO: 174 - DNA, 4482 bp, Homo sapiens
accttggccgggattaccctccgagttccaggccatgacaaatgacatcactcccggcccaggcttaaaatctccccatgtgaggggatgtgtttccttcagcctctgctgtctggccgctctgtctaggtcctgggccacgggagagccccgtccctcctttctgaaggccccctgacttgggcctcagtgtccccgaagatcatgatggcgtatatgaacccggggccccactattctgtcaacgccttggccctaagtggccccagtgtggatctgatgcaccaggctgtgccctacccaagcgcccccaggaagcagcggcgggagcgcaccaccttcacccggagccaactggaggagctggaggcactgtttgccaagacccagtacccagacgtctatgcccgtgaggaggtggctctgaagatcaatctgcctgagtccagggttcaggtttggttcaagaaccggagggctaaatgcaggcagcagcgacagcagcagaaacagcagcagcagcccccagggggccaggccaaggcccggcctgccaagaggaaggcgggcacgtccccaagaccctccacagatgtgtgtccagaccctctgggcatctcagattcctacagtccccctctgcccggcccctcaggctccccaaccacggcagtggccactgtgtccatctggagcccagcctcagagtcccctttgcctgaggcgcagcgggctgggctggtggcctcagggccgtctctgacctccgccccctatgccatgacctacgccccggcctccgctttctgctcttccccctccgcctatgggtctccgagctcctatttcagcggcctagacccctacctttctcccatggtgccccagctagggggcccggctcttagccccctctctggcccctccgtgggaccttccctggcccagtcccccacctccctatcaggccagagctatggcgcctacagccccgtggatagcttggaattcaaggaccccacgggcacctggaaattcacctacaatcccatggaccctctggactacaaggatcagagtgcctggaagtttcagatcttgtagaggacgcagtctccatctctctccatcgggcctcgggaccctttctcttctgaatctgcttccctgcagtttagatcccgggatggcattcctgagaaagcaacccgaaccagctgtccttctgacagctcggtgttcagcttacagagaccacccctttcctccacagggagaggctcctccctctcctgggacagctcacaggtcctagtgattctctcaaccctaacaccgtctggcacgattgtgaccgctgaagtacaccacgagctccaggcttcagaaagtggtgctgagaacttgctccaagaagaagtcaaaccaaacttgcagttgatttggggtcatgtttaggtcagaatcaccgtgcccttgaacaagcaggtaggggggcttgataacttaactttccacgtggacagaatttttttttttgttttgtttttgttttgcagacacagtctagctctgtcgcccaggctggagtgcagtggcacgatctcagctcactgcaagctctacctcccgggttcacgccattctcctgcctcagcctcccgagtagctgggactacagatgcccaccaccaggcccggctaattttttttgtatttttagtagagacggggtttcaccgtgttagccaggatggtctcgatctcctgacctcgtgatccgcccgcctcggcctcccaaagtgctaggattacaggcgtgagccaccgcgcccggcccttttttttttttttttttttaattgagacggagtctcactcttttgcttaggctggagtgcagtggtgtgatctcagctcactgactgcaacctccacctcccgggttgaagcgttgctcctgcctcaatctcccaattagctgggattacaggtgtgctccatcatgcccggctaatttttctattattagtagagacagggttttaccatgttggccaggctggtctggaacccctgacctcaagtgatccgcctgcctcggcctcccaaagtgctgggattacaggcatgagccattgtgcctggccctacacgtggacacttctttagcatatggttagggacctttctagaaattccaaagacagactttaagaagccccgtcgggaaaccttaggccaatgatgtggttacattaaaaataaattatctgggaatttcacagacttcacaaatgtcaggcttacatggtaggtttaggggaccgtttgagagacaaagatctacattcatatatgtagctatacatatatgtactttttcttcttagtttctttttaaagacattttatcactcattcgctcattagcacattgggaatgtgtgtatttggtagggaaatgaaaggcaccttgcctgttccatctctactccttttttcttttgttttaggattttctaaaggtgagacactggtggaactggggtagctgcttgggacgtaccacctatagttgtggctatttcacagagaagcagcagctagacagactcccatctgtaaataaacaagagataggaagagggggaaatagatttggaggaggcagccctacatttcaaacatacattcccttttttagatttttttttttttttttttggttttcagttttgatggtgggattggaaaatagagcttggcttgaggacattttcctggggtggcaccattatttcttgaaatagaatcttacttatggtgacactggcaagcacttgtgagaacctgaagacggattgaggtcatttgatgctcagaagttgggtgctgggtccctgccttctcagtccgagttctcctttcatttttgggtggggaggcgggttccaagagcccttcattggtggagttcacaaggcaaggtgtaaaaaaaaaagtagggcaggaagacagtggtgtgctggcagaggtctaacaatgggctctccaaggaagaggaaaaggttggttgtggagtgtttgtcagtttccgtggtgtaaatactcccaccacggctgacttcaagctagcaaccggaggtcactgaactaagagttgggaagagatagggcacaatatatgcttacgagttggtacacaccgtcagcagcagccagggtcaggagaaaggcgagatgtgaagagaggccgggaggtatcagatgacgtttccagcactagaccagaagaggtgcacacagcctagaccccctgaggggtacaccctgatctctagagcccacaaagaggtttttattcaacataaaacgtgttcatctctcataggcctgagtcatgctgggttctgggacattaagcccaggagtgggccgggtgcggtggctcacgcctgtaatcccagcactttgggaggccgaggcgggtggatcacctgaggtcaggagttcgagaccagcctggccaacatggtgaaaccctgtctctactaataatacaaaaattagccgggcatggtggcacgcgcctgtaatcccagctactcgggaggctgaggcaggagaattgctggaacccgggaggcggaggttgaagagagcagagattgtgccactgtgctctagcctgggtcacaagagcgaaactccgtctcaataataacaacaacaaaaataacccaggagtggctcaagagtccagtgtgggatgaaaatataaacagaggaagacaacatatgtcactggggaggctgggggagctagacaaaattcacacgggaggggcagggatgagacaatattgtgccctgggtctgtgcaaacgttgggaccagaatccactataagtttcattcttcggagacacggaagctctgcactggaggccgggactcaggcgtggaagagaatcttctccttattcaccggggaggctgtgtcttgtgcaaacaagtcatagaaacttgatgggagttggggagggactgaaggatgcatgcaaggttctgggaaggagtgagaagtagtgaaggccaaggggcccccatcacaggccgatggggtaagacttcgagagagcctgatcctggggtcttctgagactccaccaggagccggagagggcagggagccaaatccagctaggaggttacagattgcttttcctgggctgggctcctgagtgttggttcttccagctgtgcacaggggatttcaaacgttctacgtcctaaagccaggaagagtgacaaggcaggtggggacagaaggaagaagccaggagcctccctgagaaggtgtcaccttatctgtcctcctcttccccacacactggcctctgggtcccccttctctgtccacccacagagtgaaaccaattaaaatgttggatctcatttaaaaaaaaaaaaaaaaaa

SEQ ID NO: 175 - DNA, 1976 bp, Homo sapiens
agaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagaggacagaatgtttaaaa

SEQ ID NO: 176 - DNA, 2928 bp, Homo sapiens
gacaattacgtctgggtccaagcaaacatgaggcagctgccagccggcctgggcagtcttgtctgcctcggctgtgaagtggggaggctggcaacagttttcttcagcgcccaggatgcagccggctaaggaagtgacaaaggcgtcggacggcagcctcctgggggacctcgggcacacaccacttagcaagaaggagggtatcaagtggcagaggccgaggctcagccgccaggctttgatgagatgctgcctggtcaagtggatcctgtccagcacagccccacagggctcagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacagccattcatctgggctggcagaggggacagagttcagggaggggctgagtctggctaggggccgagtccaggagccccagccagcccttcccaggccagcgaggcgaggctgcctctgggtgagtggctgacagagcaggtctgcaggccaccagctgctggatgtcaccaagaaggggctcgagtgcccctgcaggggagggtccaatctccggtgtgagcccacctcgtcccgttctccattctgctttcttgccacacagtgggccggccccaggctcccctggtctcctccccgtagccactctctgcccactacctatgcttctagaaagcccctcacctcaggaccccagagggaccagctggggggcaggggggagagggggtaatggaggccaagcctgcagctttctggaaattcttccctgggggtcccaggatcccctgctactccactgacctggaagagctgggtaccaggccacccactgtggggcaagcctgagtggtgaggggccactgggccccattctccctccatggcaggaaggcgggggatttcaagtttagggattgggtcgtggtggagaatctgagggcactctctgccagctccacagggtgggatgagcctctccttgccccagtcctggttcagtgggaatgcagtgggtggggctgtacacaccctccagcacagactgttccctccaaggtcctcttaggtcccgggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcagccctagtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgccagcccaaagctggagccaatggtgagggctgagagggctgtggctgggtggtcagcagaaacccccaggaggagagagatgctgctcccgcctgattggggcctcacccagaaggaacccggtcccaggccgcatggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggagctgcatggacgcctggctccaggctccaggctgactgggggcctctgcctccaggagggcatcagctttccctggctcagggatcttctccctcccctcacccgctgcccagccctcccagctggtgtcactctgcctctaaggccaaggcctcaggagagcatcaccaccacacccctgccggccttggccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcctgtatattttaataaaataaacttgacaaaggaaaaaaaaaaaaaaa

SEQ ID NO: 177 - DNA, 1970 bp, Homo sapiens
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaaaaaaaaaaaaaaaa

SEQ ID NO: 178 - DNA, 901 bp, Homo sapiens
gggatctcggactccctggaccctccctccagcccagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgtatatcgccctgtacttggataggctggctaactcgtaggaagagagcactgtatggtatccttttgctttattcaccagcattttgggggaacatttcttttacattttaaataaaacttcagcttg

SEQ ID NO: 179 - DNA, 1341 bp, Homo sapiens
caggccaaggctggtgacagccttcatatatttaaagaggacaagagcccctcagactcagttgagctgaacggagtccacacaggcagacttgaccttgaccagatagtcttcaagatgccaaactggggcggaggcgcaaaatgtggagcctgtgaaaagaccgtctaccatgcagaagaaatccagtgcaatggaaggagtttccacaagacgtgtttccactgcatggcctgcaggaaggctcttgacagcacgacagtcgcggctcatgagtcggagatctactgcaaggtgtgctatgggcgcagatatggccccaaagggatcgggtatggacaaggcgctggctgtctcagcacagacacgggcgagcatctcggcctgcagttccaacagtccccaaagccggcacgctcagttaccaccagcaacccttccaaattcactgcgaagtttggagagtccgagaagtgccctcgatgtggcaagtcagtctatgctgctgagaaggttatgggaggtggcaagccttggcacaagacctgtttccgctgtgccatctgtgggaagagtctggagtccacaaatgtcactgacaaagatggggaactttattgcaaagtttgctatgccaaaaattttggccccacgggtattgggtttggaggccttacacaacaagtggaaaagaaagaatgaagaggtgcgccgtttctcagattttttgcgagcctaaaacacttgccaagtaatcctgcacagatcgatacctttccccaaatagcctctcctttgtagtcgtacattatgtgtttctcctcagaagtgatcaggtctttactgaatgttagaagaggcctttggaagaaaattatgtaaagtttaatctataacaaatgctttattatttataatgcttggaatgggagaggcaataaataaatgttttagtgctatcttgtatggctctagatcttttctttgagatagaaattttcaaaaacataaagctagttcaaaaaacgagttgcagagcatataataaatttggatgtcaactgagaaaggagtgagaaggaagaaacaatgcgcaaaggaaagcagtctttcagaatctgtcagccaagtgtctttctagttactgctaatggagaagaaaacagggggtctgggagaaaatagagaacatgatagcaaaatctaaaaggaaaatcaaaactaataaaattgctgaagagttgatccctttgtcctatcgtggggctttgtaatgttacacatctcgtgaaaactcagaaatgacaataaagcgtggcatttgcctctgtattataaatg

SEQ ID NO: 180 - DNA, 3797 bp, Homo sapiens
gtgtctgagcctgtggagcgattaaaccgtgcgcggagctgcttctttggcggcagcggcggcggcggtggccggtgcggacgcgcggagctcgccggagacgccgggtggccggagccgtggagcggcggcggagcgggcgccgcggggggtgtggcgcggagaatgattacggacctgaagccaaagaacaagatgcgctagtggacagattgctgaccaggggcttgagagctgggttctattttccctcctcaaactgactttgcagccacggagaggcaggggaaatggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttacaggttgtaaatatggaggaacagcccataaacataggagaacttcagcttgttcaagtacctgttcctgtgactgtacctgttgctaccacttcagtagaagaacttcagggggcttatgaaaatgaagtgtctaaagagggccttgcggaaagtgaacccatgatatgccacaccctacctttgcctgaagggtttcaggtggttaaagtgggggccaatggagaggtggagacactagaacaaggggaacttccaccccaggaagatcctagttggcaaaaagacccagactatcagccaccagccaaaaaaacaaagaaaaccaaaaagagcaaactgcgttatacagaggagggcaaagatgtagatgtgtctgtctacgattttgaggaagaacagcaggagggtctgctatcagaggttaatgcagagaaagtggttggtaatatgaagcctccaaagccaacaaaaattaaaaagaaaggtgtaaagaagacattccagtgtgagctttgcagttacacgtgtccacggcgttcaaatttggatcgtcacatgaaaagccacactgatgagagaccacacaagtgccatctctgtggcagggcattcagaacagtcaccctcctgaggaatcaccttaacacacacacaggtactcgtcctcacaagtgcccagactgcgacatggcctttgtgaccagtggagaattggttcggcatcgtcgttacaaacacacccacgagaagccattcaagtgttccatgtgcgattacgccagtgtagaagtcagcaaattaaaacgtcacattcgctctcatactggagagcgtccgtttcagtgcagtttgtgcagttatgccagcagggacacatacaagctgaaaaggcacatgagaacccattcaggggaaaagccttatgaatgttatatttgtcatgctcggtttacccaaagtggtaccatgaagatgcacattttacagaagcacacagaaaatgtggccaaatttcactgtccccactgtgacacagtcatagcccgaaaaagtgatttgggtgtccacttgcgaaagcagcattcctatattgagcaaggcaagaaatgccgttactgtgatgctgtgtttcatgagcgctatgccctcatccagcatcagaagtcacacaagaatgagaagcgctttaagtgtgaccagtgtgattacgcttgtagacaggagaggcacatgatcatgcacaagcgcacccacaccggggagaagccttacgcctgcagccactgcgataagaccttccgccagaagcagcttctcgacatgcacttcaagcgctatcacgaccccaacttcgtccctgcggcttttgtctgttctaagtgtgggaaaacatttacacgtcggaataccatggcaagacatgctgataattgtgctggcccagatggcgtagagggggaaaatggaggagaaacgaagaagagtaaacgtggaagaaaaagaaagatgcgctctaagaaagaagattcctctgacagtgaaaatgctgaaccagatctggacgacaatgaggatgaggaggagcctgccgtagaaattgaacctgagccagagcctcagcctgtgaccccagccccaccacccgccaagaagcggagaggacgaccccctggcagaaccaaccagcccaaacagaaccagccaacagctatcattcaggttgaagaccagaatacaggtgcaattgagaacattatagttgaagtaaaaaaagagccagatgctgagcccgcagagggagaggaagaggaggcccagccagctgccacagatgcccccaacggagacctcacgcccgagatgatcctcagcatgatggaccggtgatggcggagccttgtgcgtcgccaggacttctctgggctgtgtttaaacggcccgcatcttaatttttctcccttctttctttttttggctttgggaaaagcatcattttaccaaacataccgagaacgaaaacttcaaggatgatgttagaaaaaaatgtgatttaactagaacttgctgtctgatgttagcaaatcatggaatgttctgagtccctgagggtttactgtgaagtgctgaggacagtgttgacaactaactcgttttcctagatggaaacggagacattgacccctccctccatgtggtaaaccactccagaatggccaccaggcttcccagagttctatggtcttcttcccaagagagtttttaattgtaaatgcatacttgggaaggacttagagttttaaactgttttttgcttttgcttttccctgactccctttgcttggagtcagctgcacaccagtagtatggcatgctacgatcaggttctgtcctgaaagctttgcctctttcttggcaaagtttctggtatggtcaagcttgtaaataactttttttacattttaatcttttccattaattaagaggttgaaaagaagtgcagtgtaagaaaacccagcattttaattacttgcaaattaagttaccacagactctgtagtgtgtaaatgttgacaaggaattggatcacaatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcagtaatttaaaccttggatcttcaaaaaataaaataatgtgaagcaaaaccaactaaaaagtgattcttgcacatgaactgtcacatgtttaaaaatgtgttttttagagagcctcagtcttactgatttcaaacacttttttcttctgtgtattgcttttaagagagccatcagttagctatcagactctaggttgatgcattttgtacttagctgtactgtgtgatatttttcattattttaggacgccaacatgagacctgtaataaaatatgtaatggggttgaaagctggggaggaggatctactgctgtacagctaataaatcataacggattaacaagtgctccaaagaaaaaaaaaaa

SEQ ID NO: 181 - DNA, 3493 bp, Homo sapiens
acgcggtgcacgaggcagagcccacaagccaaagacggagtgggccgagcattccggccacgccttccgcggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacgaagctgctgctgaggaggcttccaccacgaagggagaacagttcccaggagagatgtttcctgtcgcctgcagagaaaccacagccagagtcaaagaggaagtggatgaaggcgtgacctgtgaaatgctcctcaacacgatggataagtgagagggattcgggttgcgtgttcactgcccccaattcctaaagcaagttagaagtttttagcatttaaggtgtgaaatgctcctcaacacgatggataagtgagagagagtcaggttgcatgttcactgcccctaattcctaaagcaagttagaaatttttagcattttctttgaaacaattaagttcatgacaatggatgacacaagtttgaggtagtgtctagaattgttctcctgtttgtagctggatatttcaaagaaacattgcaggtattttataaaagttttaaaccttgaatgagagggtaacacctcaaacctatggattcattcacttgatattggcaaggtggcccacaatgagtgagtagtgatttttggatatttcaaaatagtctagaccagctagtgcttccacagtcaaagctggacatttttatgttgcattatatacacccatgatatttctaataatatatggttttaaacattaaagacaaatgtttttatacaaatgaattttctacaaaatttaaagctaccataatgcttttaattagttctaaattcaaccaaaaaatgttttactcttataaaaaggaaaactgagtaggaaatgaaatactagattagactagaaaataaggaataaatcgattttactttggtataggagcaaggttcacctttagatttttgtattctcttttaattatgctccttggcaggtatgaaattgccctggttacattccattattgcttattagtatttcactccataacccttttttctgctaaaactactctttttatatttgtaaaataattggcagagtgagaagaaacataaaatcagataaggcaaatgtgtacctgtaaggaatttgtactttttcataatgcccagtgattagtgagtatttcccttttgccagttgacaagatttttccaccctcgagcagcgtgagagatgcctctttaacacttgaaattcatttctatctggatacagaggcagatttttcttcattgcttagttgagcagtttgttttgctgccaacctgtctccacccctgtatttcaagatcattgataagccctaaattcaaattcttaagatatggaccttttattgaaaatatcacaagttcagaatccctatacaatgtgaatatgtggaaataatttcccagcaggaagagcattatattctctttgtaccagcaaattaatttaactcaactcacatgagatttaaattctgtgggctgtagtatgccatcattgtgactgaatttgtgcaatggtttcttaatttttttactgttatttaaagatgttttacataattcaataaaatgaaatgacttaaaattgcaaaaaaaaaaaaaaaaaaaaaaaaaaaaaaaaaaaaa

SEQ ID NO: 182 - DNA, 3720 bp, Homo sapiens
aggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcgattg

SEQ ID NO: 183 - DNA, 2942 bp, Homo sapiens
cgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcagagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggttgcagccaaaaaaaaaaaaaaaaaaa

SEQ ID NO: 184 - DNA, 6841 bp, Homo sapiens
gccggagggcgcccgaggggccccgggccgcggcgctcagggcccgggcggccggcggcggccccggggctggggggagtccagcccggatattgagtgcagccattgagaaaagccaaactcttgtgtgtgcgcgtctcgatagcccccaagatggccgccaatgtgggatcgatgtttcaatattggaagcgatttgatctacggcgactccagaaggagcttaattccgtcgcttctgagctgtctgcacggcaggaggagagtgaacattctcataaacatttaattgaactccgccgggaatttaagaaaaatgtacctgaggaaatcagagagatggtggctcctgtattaaaaagcttccaagccgaggtggtggcccttagtaagagaagtcaggaggcggaggctgcttttctgagtgtttacaagcaattaattgaagcaccagaccccgtgcctgtgtttgaggcggcacgcagcctagacgacagactgcagccccccagctttgaccccagtgggcagccccggcgagacctccacacttcgtggaagaggaaccccgagctcctcagccccaaagagcagagagaggggacgtcgcctgccgggcccacgctgaccgagggaagccgcctcccaggcattcccgggaaagccctcctgacagaaaccttgctgcagagaaatgaggcggaaaaacaaaagggccttcaagaagtacagatcactttggcggccagactgggggaggcagaggagaaaatcaaagtcctacattcagcgctaaaggctacgcaggcagagctgctagagctgcggcggaagtacgacgaggaggcagcatccaaggcagatgaagtcggcctgatcatgaccaacctggagaaagctaatcagcgagctgaggctgcccagcgggaggtggaaagtctccgggaacagctggcctctgtcaacagctccatccgcctggcttgctgctctccccaggggcccagtggggataaggtgaacttcactctgtgctcgggccctcggctggaggccgcgctggcctccaaggacagggagatcctgcggctgctgaaggacgtgcagcacctccagagctcactgcaggagctggaggaggcatccgccaaccagatcgccgacctggagcggcagctcacggccaagtccgaggccatagaaaagctggaagagaagctccaggcccagtctgactatgaggaaattaaaacggagctgagcatcctgaaagccatgaagctggcctccagcacctgcagcctcccccagggcatggccaagcctgaagactcactgcttattgcaaaggaggccttcttccccacgcagaaattccttctggagaagcccagcctcctggccagccctgaggaagacccatcagaggacgattccatcaaggattcactgggcacggagcagtcctacccctcccctcagcagctcccacctccaccagggccagaagaccccctgtctcccagccccgggcagcccctgctgggccccagcttggggcctgacggcactcggactttctcgctgtcccccttccccagcctggcatcaggggagagactgatgatgcccccagccgccttcaagggagaggcgggcggcctgctggtgttccccccagccttctatggcgccaagccccccacagcccctgccaccccggcccctggccctgagccactgggcggtcctgagcccgcggatggtggtgggggcggagcggcggggcccggggcagaggaggagcagctggacacggcagagatcgccttccaggtgaaggagcagctgctgaaacacaacatcgggcagcgggtgtttgggcattacgtgctggggctgtcgcagggctcggtcagcgagatcctagcccggcccaagccctggcgcaagctcacggtgaagggcaaggagcccttcatcaagatgaagcagttcctgtcggatgagcagaatgtactggcgctcaggaccatccaagtgcggcagcgaggcagcatcaccccgagaatccgcacgcctgagacaggctcagacgacgccatcaagagcattctagagcaggccaagaaggagatcgagtcgcagaagggcggcgagcccaagacctcggtggccccgctgagcatcgccaacggcacgacccccgccagcacctcggaggacgccatcaagagcatcctggagcaggcacgccgtgagatgcaggcgcaacagcaggcgctgctggagatggaggtggcgcccaggggccgctcggtgcccccctcgcccccggagcggccatcactggccaccgcgagccagaacggggccccggccttggtgaagcaggaggagggcagcgggggccccgcgcaggcgccgctcccggtcctgtcccccgccgccttcgtgcagagcatcatccgcaaggtcaagtccgagatcggcgacgccggctacttcgaccaccactgggcctccgaccgcggcctgctcagccgcccctacgcctccgtgtcgccctcgctgtcctcctcctcctcctctggctactctggccagcccaacggccgcgcctggccccgcggggacgaggcccctgtgccccccgaggacgaggcggcggcaggggcggaggacgaaccccccaggacgggcgagctcaaggctgagggcgcgacggccgaggcgggcgcgcggctgccctactacccggcctacgtgccgcgcaccctgaagcccaccgtgccgccgctgacccccgagcagtacgagctgtacatgtaccgtgaggtagacacgctggagctcacccgccaggtcaaggagaagctggccaagaacggcatctgccagaggatcttcggggagaaggtgctgggcctgtcacagggcagcgtgagcgacatgctgtcccggccgaagccatggagcaagctgacgcagaaggggcgggagcccttcatccgcatgcagctgtggctctctgaccagctcggccaggcagtgggccagcagcctggtgcctcccaggccagtcccacagaaccaaggtcctcaccatccccaccccccagccccacagagcctgagaagagctcccaggagccgttgagcctgtccctggagagcagcaaggagaaccagcagccagagggccgctccagctcctcgttgagcgggaagatgtactcaggcagccaggccccagggggcatccaggagatcgtggccatgtcccccgagctggacacgtactccatcaccaagagggtgaaggaggtcctcacagacaacaatctagggcagcggctgtttggggaaagcatcctgggtctgacacagggctccgtgtctgacctgctgtcccggcccaaaccctggcacaagctgagcctgaaggggcgggagccttttgtccgcatgcagctgtggctcaatgacccccataacgtggagaagctgagggatatgaagaagctggagaagaaagcctacctgaaacgtcgctatggcctcatcagcaccggctcagacagtgagtccccggccacccgctcagagtgccccagcccctgcctgcagccccaggacctgagcctcctgcagatcaagaagccccgggtggtgctggcacccgaggagaaggaggcactgcggaaggcctatcagctggaaccctacccctcgcagcagaccatcgagctcctctccttccagctcaacctcaagaccaacaccgtcatcaactggttccacaactacaggtcccggatgcgccgggagatgttggtggaggggacccaggatgagccagaccttgatccaagcgggggtcctggaatcctaccgccaggccactcccacccagaccccaccccgcagagccctgactctgagactgaggaccagaagccaaccgtgaaggaactggagcttcaggagggccctgaggagaacagcacacccctgaccacccaggacaaggcccaagtgaggatcaagcaggaacagatggaggaggatgctgaggaagaggcaggcagccagccccaggactcaggggagctggacaaaggccaaggtccccccaaagaggagcatcccgaccctccgggtaatgatggactcccaaaagtggctcccgggcccctccttccaggtggatccaccccagactgtccctcacttcatccccaacaggagagtgaggccggggagcgacttcacccggaccctttaagttttaagtcagcctcagagtcctcacgctgcagcctggaggtgtcactgaactcgccctcggccgcctcctcaccaggcctcatgatgtctgtgtcacctgtcccctcctcctcagctcccatctccccatccccacctggcgccccccctgccaaagtgccgagtgccagccccactgctgacatggctggagccttgcaccccagtgccaaggtgaaccccaacttgcagcggcggcatgagaagatggccaatctgaacaacatcatttaccgactagagcgggctgccaatcgggaggaggccctggagtgggagttctgaaggcagggtgagggggcaagggacataccctggtaactaccttccttctcgcacttactctcctcaacaggatggggtaagggagggaggaactcaaccatcaaaatgtggacagcaatgttatgccgtttacgttttttgttgtaatcctagttctatgaagctgtgtgagcaggtgggtcaaatgccattgcctccacttttctgcacccccctgctcctcttcaccctgacccctctgcaggaggcagaagcaaaatggcaccacatattcacctgaaaactccaaactcttttagaaaaataaataaatatttatagacctcttttagatattttaataaaggatcctttggaatttatcccagctgatgctgttttgatattacagagagttataaaatcaggatgctgtcacaactgttgcgaagtatacactgaagttgtgtcgtttttgccactagatgagattaaaagaagacaattattcaaagccatcacaaaacactataagactgaccaaaatttagataacctttgaaccacgatttttttccacatctgtctgtgagacacagcgcaatgctactgcccttccagaaactgtgctaaaaagagaaagtccaaaagactctaaacaaaaacctcgacgccgttgaggatgtgtttcattctggtggtctgttttgcaagcttgataacagaatgtccgtgccattgtaaatgttgtagagatgtgggccgtggcccaaccgtcctatatgagatgtagcatggtacagaacaaactgcttacacaggtctcactagttagaaacctgtgggccatggaggtcagacatccatcttgtccatctataggcaagaagtgtttccagatcctttggaaaggtgggcatggggcaggtgcttggagagtggcgtttgagccagagcgaccccatttcccgtgtgaaccataggcacaacccaggaagtttccccacttgtaggagtgtgggtattccagagcaagactgtggccaccatcttcccctcttggtgttttccgaaagtgacagtgttggtcatcccatgaccactgaagcttagtaaccagcgccaaaaagtagattcatcaaactagagaccccagctccccttctcgccatcttctttctcaagttgaccgtggtgctgtttctggaaggcatctgcaactccaagtccatgcagaactctggaaggccaagttcatcgcagcatgttcaccatatcccagcctccaaatctatcctcctaccttccaacgcatgacctgttggggagcagagacttaacccccaactcagaggaacccttcctccagcgtctttggcatggtttctagggtgagagttcccaatttggatagaacggccaccatattggttactgaatctctctcccttgtttttattacgtttcctttttcaaactgtccatgggaaggctgaattgagtgactccccagaatgaagatgagaaggtgaatataatcaatgccaatgtaatgccagcgggtgagatggccgatggaggtttcaaagatgtagctagcattttgaaaccatatgggcaaaacccggcaaccagaaggggacagataaggaccgttccagaaatcccaactctcacacccagcccaggctgcagtctccacaccaaacagtcaacaaaacacaaaccctgaaggaaaaccttttccatacacccaggctatgcattgaagagttttccactgtatacatttttatccagatgaaggtatttttatattttgacaataggaaacagtgaccattttcagagtaatcaaatctggaacaaatgaaacatcttttagccaccaccaccctgttgcaattaagacaaccgtgggggaacacaccactttttactgttgaaaccaacacaacgttgaaatccaggcttatacgcagactccgattcctagagaactaaatttggctttagtgtgacgggatttgattaagcacttagtatagtcttttgaacacggaaatcctgttgtacttaaagctagcggacccgtgaacaactttgtcaggttcacgtcctataacggttaaaaaacacacacacacatacacaaaccgtttctatgagagattgatgaactttgtttaaaattttaaaaaaaggaacacgttctgtaaacgagtcgctaaatacagaattgtataat

SEQ ID NO: 185 - DNA, 4413 bp, Homo sapiens
ggcgcggagccgggcggtgggaatggagcgagcagattgaggccgccactgcagcgccgccagcatgaacttggccgcgagctgaagcggccggcggcgggcgggcgcgggggcaccggccgctagccagggggtgatctgcaacagggctgggttccttggcggccgcctgagtccaggctgcccgcgccggcggccgcccgcccctcggacactgcccccgccgccgccggagctctgcagcacgccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagctgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggagaaaagtgcca

SEQ ID NO: 186 - DNA, 4640 bp, Homo sapiens
atctttgatcaatgtacttgccagggagagcccaagtccttcaaacctcctccttttcaccttcatccttaactttgtgctagagcgagacccacacaacaacagccgaccctccccgccccacccccacccccaaaccagccctcgatcccagcccccggagaggactcgcatttcgacttgcgggacacttttgtgcgttcctctccagagcgcctctcgtgctcgcccctcttgcgctcgctctttattaccttcacctccttttctcccccttctctccctttctccttctcgttctctcccggagttgttgttgcccccctcgctccttctccccccttttttccccttcccctcccgggggtgtgtggcaacttttcctctcgcttctcctccgtctgtttccccttatatgtgaccatggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggtttttttttcttaaaaataaaaaaaaatatataagtgtaacatgttttcattccaaactggtagtggtatatagaattaaagataataatgttgcttcttattcaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctggagtcacagtattaatgaatgagatcttaagcatctggtgacatcagaactctgtgtcagccacttttatttgtatattgaaccctagctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgcttattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgtttgttatgtggattaaatagttttaaaatacatatttgaagacctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggtttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctcaaaaaaa

SEQ ID NO: 187 - DNA, 3727 bp, Homo sapiens
gcttctctgtggtcttgacaagcgctgcctgggctccgccggctcactaataactgagtgaccttttctttggctgtattatgtctggctgggaagggattgcattttgcagctgagagccggagcttccttcagctcggctcctcgcacgctgctggggtaagttgtcttgaaccaggacggagagagacagcctcggactgcagttgcctaaaaggaggacacctgtggctcagatgcggtcaacaccattgcttggcgtatccttgaggacctcattattttaaacttaaaaaaaaatagacattccctcccccgtcttttttttttttttcaaacaatgcttctttttgacctttcccaaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcacttttttacatttggatttatgtttttaataaaaggggtgttacact

SEQ ID NO: 188 - DNA, 2816 bp, Homo sapiens
cacgcactacgggttggcgccagagtcaaaaggcgtcggccctctggcaagatggctgctgcggaggcgttggagcgcggaaatctggaaccgggatggcgacgtctacactgagtcggaggcgaaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagtcaaaaaaaaaaaaaaaaaa

SEQ ID NO: 189 - DNA, 1658 bp, Homo sapiens
cgcgcacacctctcggtgcagattgcaaagcgccttccgttgcgagagctgcagattttgcaagagccaggctcgcccaccttgtagaaggagcgccttgagtcccctctcaccctcggttgcaaagagccgaccgcttgatctggacaccccctcgcccagattgcatgatctcccgggaccctcttgagttgcacgtttctgcaccgaggacctcaaatccccgtcgctcctaggatttgcagcgttctggatactggagggttgcaggctacactcgcccgcccctgggcagacactcgtccaaaccactggagtgtgctggtgactggcaggccagcccttcgcctctccatgaacccgtgagcctgggggcaggtgccaggcgatggcgcggcctgtgagcgacaggaccccggcccctctgctgctgggcggcccggccgggacaccccctggcgggggagcgctgcttgggttgcggagccttctgcaggggaccagcaagcccaaagagccggccagctgtctcctgaaggaaaaggagcgcaaggcggccctgcctgcagccacaacccctgggccaggcctggagactgcgggcccggcggatgccccggctggggcagtggtgggcggagggtccccgcgggggcgcccggggccggtgcccgccccgggtctgttggcgccactgctgtgggagcgcacgctgccgttcggcgatgtggagtacgtagacctggacgccttcctgctggagcacgggctcccgcccagcccgccgccccccggtggcccgtcgccggagccgtcgcccgcgcggacgcccgcaccctccccagggccgggttcgtgcggctcggcttccccccgctcctctcctgggcacgcccccgcccgggctgccctcgggaccgccagcggccaccgcgcaggcctgacctctcgggacacacccagccctgtggacccagacaccgtggaggtgttgatgacctttgaacccgacccagctgatcttgccctatcaagcattcctggccacgagacctttgaccctcgaagacatcgcttctcagaagaggaacttaagccccagccaatcatgaagaaggcaagaaaaatccaggtgccggaggagcagaaggatgagaaatactggagccggcggtacaagaacaacgaggcagccaagcggtcccgtgacgcccggcggctcaaggagaaccagatatcggtgcgggcggccttcctggagaaggagaacgccctgctgcggcaggaagttgtggccgtgcgccaggagctgtcccactaccgcgccgtgctgtcccgataccaggcccagcacggggccctgtgaggctgccccacatccccacctggcggagctctcctccgccttgctgagacttacgccctgttcccttcctgccctgtggcccacgggccggccagctgggtgccccagggacgtgataatgcagataaatacatttatatttttaagaaaaagcgagcctcccccctcccttgcgggggcggggagggttctctgtgtgtgtccccggcacgtcagggaccctatcctcccaccgcctccgttaacacgatcctgaataaatcttgagaaccccagaaaaaaaaaaaaaaaa

SEQ ID NO: 190 - DNA, 927 bp, Homo sapiens
gaggtcagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgagccaaaaaaaaaaaaaaaaaa

SEQ ID NO: 191 - DNA, 2737 bp, Homo sapiens
tgacgaaggggcccgaccgcgccgcgtttcgggagcggacgtccgagccacggccgaggcccgattagtccgtccggcaccgctcgggcactttcggaagggaagaggtggagaaccgacgttcgggagcattcggcctcggggacattcggctcgtctcggctcggcctcgggctgactcggcttccgccggcggcgggaacgggcgaaacccgcggcactaagctctctctgagaggcagaattgcgccggccgccggcgagaatctgcctagagccgtccagccctgtcggccggggacgacagccgcctcagcctgtcaggacagtgaggagagcaggggccgagtctctcggaagccctcgtgaggactcggacctattcggactgattcggcttcccacttcggggaacttcgaccctcctcggttcaggactcggtctcggctcggcggcttcgtgcaggttcggctcctactcgggcagcctctgttcgcctcggctccgctccgcgggcggactcggctcggctctgctcggcggctggctgccttttcggtccctattcgggcggcggcttcgggcggcctcggcccagctcgggcgtcctcttcgggccccgcttcgggctccgcgaccggcgcttcgggcggtcccggacggcgccttcgggaaggctcggcggagtccggatggaggactcggactcggcggcaaagcagctgggcctggctgaggcggcggcggtggcggccgcggccgctgtggcggcggcggccgcggccgcggcaggaggcgaggcggaggagccggtgctgagcagggacgaggactcggaggaggacgcagactcggaggcggagcgggagacgccgcgggtcacggcagtggcggtgatggcggcggagcccgggcacatggacatgggcgccgaggccctgcccggccccgacgaggccgccgctgccgcagccttcgcagaggtgaccacagtgacagtggccaacgtgggggctgctgcagacaatgtcttcaccacgtctgtggcgaacgcggcatccatctcaggacatgttctgtctggtaggacggcccttcagatcggggacagcctgaacaccgaaaaagcgacactgattgtcgtccacacagatgggagcatcgtggagaccaccgggctgaaaggcccggcagctcccctcaccccaggtcctcagtctcctccaacccctctggctcccggccaagaaaaaggtggaactaaatacaactgggacccttctgtgtacgacagtgagctgcccgtacggtgccggaacatcagcggcactctgtacaagaacaggctcggctcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtgaagaaggactcccccaagaacatcacattgcttccagccaccgcggctaccaccttcaccgtgaccccctcgggacagatcacgacctcgggggcactgacctttgaccgagcgtccacggtagaggccactgctgtcatatcagagagtccggcccagggcgacgtcttcgcaggggccacagtccaagaggccagcgtgcagcccccatgcagggccagccaccctgagcctcactaccccggctatcaggacagctgccagatcgcaccgtttccagaagctgcgttgccaacgtcacatcccaaaatagtgttgacatccctgcctgcgctggcggtcccacccccgactcccaccaaagcggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaaggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtctccctgccaaaaaaaaaaaaaaaaaaaaa

SEQ ID NO: 192 - DNA, 4183 bp, Homo sapiens
cgcagtgctgctggggcattgcctgtgacaaccaggtctacgtgtatgtgtgtgccagcgatgtccccatccgccgccgagaggaggcctatgagaatcagcgctggaatcccatgggcggcttctgtgagaagctcctgctgagtgaccgctgggggtggagtgacgtgagtgggctccagcaccggccgctggacagggtggcactgccctcgccgcactgggagtgggagtctgactggtacgtggatgagaattttggaggtgaacccactgagaaaggggggtggacgtacgccatcgactttcccgccacctacacgaaagacaagaagtggaattcttgtgtgcggcgccggaagtggatccggtacaggagatacaagtcccgggacatctgggccaagatcccctcgaaggatgaccccaaggagctgcccgaccccttcaacgacctctctgtagggggctgggagatcacggaggagcctgtgggccgcctgtcagtgtgggctgtgtctctgcagggcaaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctactaaaaatacaaaaaaaaaaattagctgggcatggtggtgggtgcctgtaatcccagctactcgggaggctgaggcaggagaatcgtttgaacccgggaggcggaggctgcagtgagccgagatcatgccactgcactccagcctgggcgacagagactccatctc

SEQ ID NO: 193 - DNA, 2565 bp, Homo sapiens
gtagcgcttgtgtcgacatcggcgcgcgccgagcccggaagaggcgcgggctaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtgggagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaactgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcaggaaaaaaaa

SEQ ID NO: 194 - DNA, 3122 bp, Homo sapiens
gagtaactagagcaacagttgttctccctcgctggagtggtgaataggagccgggaggaggggactgttagggtcgggctgcctcagtctccacagtaattaagaggaaattgagttggatacagcggacatgaggcctggaatgggtaccccaaacccatgcatcttaagtgtctgggtccccacgcccccttctgcctgccaggagtactctgtgcagccatcctgtaactgcttcagtccagagaaggatagcatccatccctccctccagctcgcctctctgctgaggctttctcctctccactcagcatttgcaacagcttctctcctggcacttgtctgggaatatcaagttaaaaattacaacacccaattttgataactttagttgagagaaacaacctctagtgaagactgataagtaacttattgcccgtagtcccatgttcctttgtctccaccaagaggaattaccagcccagcagttctgccctcactagagtcccgtccaggagcttgagaggagaggatttttagggctggactgcctcagtctgcacagtaataagttgagttagacacagtggacatgaggacctggactcagatatctgaagaatccttattatttttttgttggcttgttttgagacagagtcaccctgttgcccaggctggagtgcattggcgcaatcttggctcactgcaacctctgcctcccaggttcaagtgattcttcttcctcagcctcccaggtagctaggattacagacatgcgccaccacgctcagctatttttcgtatttttagtggagatggggtttcaccatgttggtcaggctggtcttgaacaccagcctcagcctccccaagtgctgggattacaggcatgagccacagtgcccggccaaaatccttaatgtttttgttttttggtttttttttttgagacagtcttgctctgtcacccaggctggagtgcagtggcacaatcttggctcactgcaagctccgcctccggggttcatgccattctcccgcctcagcctcccgagtagctgggactacaggcgcctgccaccacgcccggctgattttttgtattttttagtagaggcagggtttcaccgtgttaggatggtctcgatctcctgacctcgtgatccgcccgcctcggcctcccaaagtgctgggattacaggcgtgagccaccgcgcccgggctatccttaatgttgatattagtggttagcacatgttttggaggaggacttcacactttttaaactatgctccctcgtattttctataagcagtcttaaattctttctggaataaagcaagattgatcagtatttctcaaggaggattatttggcaggcagtagctactgctcagagaacttggtattgttacatgcatcctggaagtatctgtgcctatttctagacggcctcagacgacttttttctgagtcctggacccttgaatctgcagccaagcaagctcttgggtccctcccaagtctcatgtttagtaaagccctgtgagaataattttattggtggaggagtcaagatgatacttccctcacctgcatcagaggaaaccacatcagaaacaatccacctagaaaaacactgcatacaggaaagctgacaacttgccctgagaaatcacagctttggtgcaagaggtgaagccgaactggtaaaagatcaaagtgaattcagagatcaaactgtactagggaaaggagcagaggctgagatcttgctgccagcgtgacctctcacagagtggcccagcagaggctgtgcagagatggccagagccaggacccagccctgtggagcccctgggcacatgtggtcccgagtgaagccgtgcctgttgctctgaacaggtgggatcaatctgtaggtttttccacttttcacagagtgtggctctctttaggtctgcactccctctctgcgcagggcggacctccctgggctctgcagcatgatctcctgtcccaagacagtcgtgctcttggacagttagcttctgtcattaggaagtgcccacatgagctcttgtttattggaaaccgtgttctatgcctcctttggggtttctgcaactcagtttggcaggtagcttagtggtccacttggtctcaaattccagctccaccatgtgcagttgtgtgttctttggcaagttcctcccctcctccgaatctgtcagtgggggaagagtgcatgtctcacagagttgaggtgagaaataagttaatgaatatgaaattctttgcccagcccctggcacgtggaagggctcagcaatcctgtatccgttgtagtggtcatcactctgtggctcttcactgcttttgttttgttttgggagggggtggagaacaatttgttctgtgtttgtgtggggcaaggcctgtcttcagggctctctccaaccacgtacgctctggctggagcttctgaaaggacacagttcttgcatagaagttgctttctccagcttgcccaccaggcagtctggcttcagacatctatgttgcccttttaagtcaatttggctgtttaagtggaatgtttgtgtcagtctgataattgttaattcatttgatcctcataccaacccttacttgcctccttttacagatggaaaaatcaaacttggacagtaatttccacaaggaaaagccccacagctggaaagcggtgggagcaggaggccacactgggtacaggagtacccatctccccacaggagccccacactgtctcacccttaggaagcccaaatgctcactccttgagtttctaatgcattctttctgatgtacaggaagaggggaaggaaggaagagcttttccatttggtgctccaatgtctcctgctggacccatctgcctagtggaaggcagcaaaatttcaagaaacaggtgaggttgagcagcttggtgcaaccccatggggcctggagttggagctcaacagcaatggatttcagagaccaccctgaaactcccagtaaaaaagacttgggagacatgttaataaactcaagcatttgatcgacccaaaaaaaaaaaaaaaaaaaaaaaaaaa

SEQ ID NO: 195 - DNA, 3326 bp, Homo sapiens
gaggggcggcccgcggccatggagacgggcacggcgcccctggtggccccgccgcgccgtcatggcgcccccgcggccccctcgccgccgccccggggttcccgggccgggcccgtcgtggtggtggctccgggacctccagtgactacggccacttcggcccccgtcaccctggtggcccccggggaggcgcggcccgcctgggtcccggggtcggccgagacctctgctccggccccggccccagccccggccccagccccggctgtcacgggcagcacggtggtggtgctgaccctggaggcctcgcccgaagccccaaagccgcagctcccctccggcccggaatccccagagcccgcggcagtggctggagttgagacatcgagggctctggccgcaggggcagactcgccgaagacagaggaggctcgaccctcacccgccccaggaccagggacccccaccgggacccctaccaggaccccttccagaacggctcctggtgccctgaccgccaaacccccgcttgcccccaagccgggaaccacagtggcctcaggagtgactgcacggagtgcatcaggacaagtgacaggtgggcatggagctgccgcagcaacatcagcatcagcaggacaggctcctgaggacccctcaggccctggcacaggcccctctgggacttgtgaggctccggtagctgtcgtgaccgtgaccccagctccggagcctgctgaaaactctcaagacctgggctccacgtccagcctgggacctggcatctctgggcctcgagggcaggccccggacacgctgagttacttggactccgtgagcctcatgtctgggaccttggagtccttggcggatgatgtgagctccatgggctcagattcagagataaacgggctggccctgcgcaagacggacaagtatggcttccttgggggcagccagtactcgggcagcctagagagctccattcccgtggacgtggctcggcagcgggagctcaaatggctggacatgttcagtaactgggataagtggctgtcacggcgattccagaaggtgaagctgcgctgccggaaggggatcccctcctctctcagagccaaagcctggcagtacctgtctaatagcaaggaacttctggagcagaacccaggaaagtttgaggagctggaacgggctcctggggaccccaagtggctggatgtgattgagaaggacctgcaccgccagttccctttccacgagatgtttgctgctcgaggggggcatgggcaacaggacctgtaccgaatcctgaaggcctacaccatctaccggcctgacgagggttactgccaggcccaggcccccgtggctgcggtcctgctcatgcacatgcctgcggagcaagccttttggtgcctggtgcagatctgcgacaagtacctcccaggttactacagtgcagggctggaggccattcagctggacggggagatcttttttgcactcctgcgccgggcctccccgctggcgcatcgccacctgcggcggcagcgcattgaccctgtgctctacatgacggagtggttcatgtgcatcttcgcccgcaccctgccctgggcgtcggtgctgcgtgtctgggacatgtttttctgtgaaggcgttaagatcatcttccgggtggccctggtcctgctgcgccacacgctgggctcagtggagaagctgcgctcctgccaaggcatgtatgagaccatggagcagctgcgtaacctgccccagcagtgcatgcaggaagacttcctggtgcatgaggtgaccaatctgccggtgacagaagcactgattgagcgggagaatgcagcccagctcaagaagtggcgggaaacgcggggggagctgcagtatcggccctcacggcgactgcatgggtcccgggccatccacgaggagcgccggcggcaacagccacccctgggcccctcctccagcctcctcagcctccctggcctcaagagccgaggctcccgggcagctggaggggccccgtccccgccgccccccgtccgcagagccagtgctgggcctgccccagggcctgtggtcactgctgagggactgcatccatcccttccctcacccactggcaatagcacccccttgggttccagcaaggagacccggaagcaggagaaggagcggcagaaacaggagaaggagcggcagaaacaggagaaggagcgggagaaggagcggcagaagcaggagaaagagcgagagaagcaggaaaaggagcgagagaagcaggagaaggagcggcagaagcaggagaagaaggctcaaggccggaagctttcgctgcgtcgaaaggcagatgggcccccaggcccccatgatggtggggacaggccctcagccgaggcccggcaggacgcttacttctgacctctgccctggggctggactgcatggcccccctctttccctcagccaagaacaggcctggcccaaggtgccaccccctagcaccttgtcaggctgtcccttgctggggaaagtggcttggttccccatctcctcgccagctgctgatccctacacgggcaggacagatgggcagctgcaaatgagtctggagcctctcatctcccatgaggctcagctggggtctctgtcgctcctgccccagttccctctgggtcccctcctaggtgctgtcctgaatggcccgttgtcatcccaggggtgactcctggtgatgggagtcagcagtttcagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttccataatgctcctgtacccagtttatttaaggggacatgcactggaataggaaatgtcccccatctcccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgggaaaaaaaaaaaaaaaaaaaaaaaaaaaaaaaaaaaaaa

SEQ ID NO: 196 - DNA, 3151 bp, Homo sapiens
ggccctagcggcttggcggagctggagccctccctggcagtgcgtcggcgctgggctatggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcgaggcttctcagaactttgcttctccagcagaataatcctgcggaagactgagcagttcttgtgagtgtaaaaccatggcccatgcattggtgacgttcagggatgtggctatagacttctctcagaaggaatgggagtgcctggacactacccagaggaaattgtacagagatgtgatgttggagaattataataacttggtctcactgggatattctggctcaaagccagatgtgattaccttactggagcaagggaaagagccctgcgtggtggcgagggatgtgacaggaagacagtgccccggtttgttatccaggcataagaccaagaaattatcttcagaaaaggacattcatgaaatcagtttatccaaagagagtataatagaaaaaagtaaaactcttcgtctgaaaggatccatttttagaaatgagtggcagaacaaaagtgagtttgagggtcaacagggacttaaagaaagatctatcagtcaaaagaaaatcgtctctaaaaaaatgtcaactgatagaaaacgtccctcttttactctgaatcagagaattcacaatagtgagaaaagctgtgactcacacttggttcaacatgggaaaatagattctgatgtgaaacatgattgtaaagaatgtgggagtacttttaataatgtctatcagcttactctccatcagaaaattcatactggtgaaaaatcctgtaaatgtgagaaatgtgggaaagtttttagtcatagctatcaacttactctgcatcagagatttcatactggtgagaaaccctatgaatgtcaagaatgtgggaagacctttactctttacccacaacttaatcgacatcagaaaattcacactggtaaaaaaccctatatgtgtaagaaatgtgataagggtttttttagtagattagaacttactcaacataaaagaattcatactggtaagaaatcttatgaatgtaaagaatgtggaaaagtttttcaacttattttctactttaaagaacatgagagaattcatacaggtaagaaaccctatgaatgtaaggagtgtgggaaagcttttagtgtatgcggacaacttacccgtcatcagaaaattcatactggtgtaaaaccctacgaatgtaaggaatgtggaaagacctttagacttagtttttaccttactgaacacagaagaactcatgcaggtaagaaaccttatgaatgtaaggagtgtgggaaatcatttaatgtgcgtggacagcttaatcggcataaaacaatccatactggtataaaaccttttgcatgtaaggtgtgtgagaaggcttttagttatagtggtgacctcagagtacattctagaattcatactggagagaaaccatatgaatgtaaggaatgcgggaaagcctttatgcttcgttcagtccttactgaacatcagagacttcatactggtgtgaagccctacgaatgtaaggaatgtgggaagacctttcgagttcgttctcaaattagtctacataagaaaattcatactgatgtgaagccctacaaatgtgtacgatgtgggaagacctttagatttggtttctaccttactgaacaccagagaattcacactggtgaaaagccctataaatgtaaagaatgtggaaaggcctttattcgtagagggaatcttaaagaacatctgaaaattcattctggtttaaaaccctatgactgtaaagaatgtgggaagtcctttagtcggcgtgggcagttcactgaacatcagaaaattcatacgggtgtaaaaccatacaaatgtaaagaatgtgggaaggcctttagtcgtagtgtagaccttagaatacatcaaagaattcatactggtgagaaaccctatgagtgtaaacaatgtgggaaggcctttagacttaattcacaccttactgaacatcagagaattcacactggtgagaaaccctatgagtgtaaggtatgtagaaaggcctttagacaatattcacatctttatcaacatcagaaaactcataatgtaatttaatataagaaaaggtttccatgtcatgctctatttatagaatatcaaaatatttatggccagaagttctgtcaatgtgttgatgtttttttacacatattaacttaataaatgtatgagtcttaaatacctcttagttctcattaaatttaggaaaattcacactagaaaataaagctgttaatgtaacagttgtggaaaagtgttctagcaacagcatatacttatcatcattgcctttccactactctactatctgtgtgatattagacaaaatatttgcttcttggtacctcagctgtaaaatgaaacacacctaaaagtgtggttgtttccaacatgtataatacagcaacaactatctggcccaaactgctttggattaatattggatattactgtttttattatcatcaacattattattagtggatttcttaataggaagatgcaatggagatgacaaatttggaaaaaccactcatcacttacatttcatgaagtacttctttgataaaatctgttatgggctgaatgtttgtgttcccgtaacaattcctatgttgaaacacgaatcccaaggtgatggtatttgaaggtagggcctttaggaggaaattaggtcatgagggtggagccttcatgagtggaattactgcctttataagaagaagccaaagagccagctagctctttcaaccacatgaggttacagcaagaagtcagcagtctacagtgcaaaagagggccttcaccagaacccaagcatgctggcaccttgaccttggactttcagcctccaaaactgtgagaaataaacctcagttgtttataagcca

SEQ ID NO: 197 - DNA, 2308 bp, Homo sapiens
aagaggatgcgaccagaggcagctgtcccgagcagcgcacggtgatcgcctcccccggaggaggaggcgcctagacggttgcctcctttcttgtttccccaccaccacccccgtaattacattggctgctggaggggaccgggagagacagaggaggcgcctggcttcccccgcacgcccgccacctctgctctttcccgtctcgggccaggatgactggagtctttgacagtctagtggctgatatgcactcgacccagatcgccgcctccagcacgtaccaccagcaccagcagcccccgagcggcggcggcgccggcccgggtggcaacagcagcagcagcagcagcctccacaagccccaggagtcgcccacccttccggtgtccaccgccaccgacagcagctactacaccaaccagcagcacccggcgggcggcggcggcggcgggggctcgccctacgcgcacatgggttcctaccagtaccaagccagcggcctcaacaacgtcccttactccgccaagagcagctatgacctgggctacaccgccgcctacacctcctacgctccctatggaaccagttcgtccccagccaacaacgagcctgagaaggaggaccttgagcctgaaattcggatagtgaacgggaagccaaagaaagtccggaaaccccgcaccatctactccagtttccagctggcggctcttcagcggcgtttccaaaagactcaatacttggccttgccggagcgagccgagctggcggcctctctgggcctcacccagactcaggtcaaaatctggttccagaaccgccggtccaagttcaagaagatgtggaaaagtggtgagatcccctcggagcagcaccctggggccagcgcttctccaccttgtgcttcgccgccagtctcagcgccggcctcctgggactttggtgtgccgcagcggatggcgggcggcggtggtccgggcagtggcggcagcggcgccggcagctcgggctccagcccgagcagcgcggcctcggcttttctgggcaactacccctggtaccaccagacctcgggatccgcctcacacctgcaggccacggcgccgctgctgcaccccactcagaccccgcagccgcatcaccaccaccaccatcacggcggcgggggcgccccggtgagcgcggggacgattttctaaccccagggagaactcgccagagactgagagcagagaccacttatcctcattgcttaccccgagccggggttccctcctcccggcccgctgccgccacccacctctcctgcaggctgcgacctgcagtggcccgtctcaggccctgctcactcccggggccaccaaacgggcccctctctcgggggaaccggacagcagcttggcaaaggcctccctaaaaggccgcatttctgacctgagccccgggtctcggctgtttcgagccccgcctcggacttgccttccctcccctccgggtgagcctgtctggcgccttcctcgccccgggctgagagctgggtcccgggagatggaagcctcccaggcgcgcgaggcttcccgggcgctctgaggcttctttctcctcgcccgctcccctgggctcagctcggacgctgcagttattgacctcccggtcccgcctgcccgccctcccccacgtggccccttgacccgggcggccccgccgcttctttccttcctgcagttcccagccctcggagcccccatcccttatcttacccccaccgcgctcccccaggagcgctccctcagctctctcctcatccatcaccagtggagtttttttatttgttatttttttaaaagtttaggtgcctttgcggatgacctcattttgacgttgaaaaaatgattttttaatatgtgaacactgcaaaaatgtgtttaaattatcttttttaaaacctattcaggattattagcctggacttggacacagagtttgtaaataaaggtgtctgtgcagattttcccactgatttatttgtataaaaatactcatcttttcagacttttttgtaaacccccagttgtgaaaactgcagtttagcagtgacctcagcaacccctcctttttattttttcctttaaaaacatttcagttaaattaagctactgatttggatttgttttatcgtatcctaaagtctttgttgttgaaatgaaaggtattttggggttatttattatgaaaacaacatgctcttaatgttgattttacaatatgaagagattatttaaataaattattgttttcattggaaaaa

SEQ ID NO: 198 - DNA, 2613 bp, Homo sapiens
agcatttgattgtggcttgggacgcgaggagaggcgcgcagcgaccgcctgacggcaggcaatggtgtaagcgcctctcggcctccccctccccccagacgcggccgggtcctcccttcgccttctggacacacacccctgcctcgtctcttccgcctctctcgcactccggtccgttcctgtcctctgcggaggccagccctggggaggtgcagcgcccgccaggatgagtggctccttcgatcgcaagctcagcagcatcctcaccgacatctccagctcccttagctgccatgcgggctccaaggactcgcctaccctgcccgagtcttctgtcactgacctgggctactacagcgctccccagcacgattactactcgggccagccctatggccagacggtgaacccctacacctaccaccaccaattcaatctcaatgggcttgcaggcacgggcgcttactcgcccaagtcggaatatacctacggagcctcctaccggcaatacggggcgtatcgggagcagccgctgccagcccaggacccagtgtcggtgaaggaggagccggaagcagaggtgcgcatggtgaatgggaagcccaagaaggtccgaaagccgcgtacgatctactccagctaccagctggccgccctgcagcgccgcttccagaaggcccagtacctggcgctgcccgagcgcgccgagctggccgcgcagctgggcctcacgcagacacaggtgaaaatctggttccagaaccgccgttccaagttcaagaaactctacaagaacggggaggtgccgctggagcacagtcccaataacagtgattccatggcctgcaactcaccaccatcacccgccctctgggacacctcttcccactccactccggcccctgcccgcagtcagctgcccccgccgctcccatacagtgcctcccccagctacctggacgaccccaccaactcctggtatcacgcacagaacctgagtggaccccacttacagcagcagccgcctcagccagccaccctgcaccatgcctctcccgggcccccgcccaaccctggggctgtgtactgagcacccatctggcctgcacccttgacaaaggaccccaggaccaggcagaaggcgcctccgtcctagccactcaggaatcatcgaggagcacagggaaaaggaactccctttccccctcccttgccccttcctccagggacccaagcgcttccagatgacatttgcatggaccaaggatgccccctgaacctccctccctctgcctagacactggggtacccctccagatgtggggacattccaccccagtggggacagccattcccctacctgctccaggagcctggattggctttaaatggctcatcatcttccagcttcttaaacttagtgcctgttcccagactggagaccttgggatgggggagagtgtggagggtttgcgggtcctgcctgtgctggggcacctggcaccgtggatcttaaaacttgccaggcctagttcctcctgagcctctggtggtctccccctgctcgagcggcccctcggccaataagacagtggacatcatgacgaggactccgggtggggacctgaactggtcaccgccctgcacttctagccctcatttaagatttgagggtgaaaccaaagaaaaccccctaagtgagggaatcttttaatatttgtggctttagaggaaagaactaaaggagccatctctctcccctctcctccgttccgagaggaggggtgggtctcagacgtttttcctatggacttatttcttccatgtccaggactttgcacaactttggttttaaaagctgttgaaaaataggaaaacaaagggcattgttcacagatagggccaagtctccccttgcaagggtgcctctgttctgtccctgcccccacctcaccttctctactcctccagtaagttggcagttttggtgccaaaccccaaatctccaaagagacataccaggcaagacaaacccccaaacacctcctttccggtggccttggaaacagattgctccgagctggagaatgtcgggtgaggtgtatgggagaggaggggagagttagaacttgtgcctttgggagtaaggggtaactgcctggagggctggtggcactgcccctccctgacccagacatcccaccaaagctaactttcccccacccctgatgcagtaaaacattgaaaaaaaaaaaaaaggagaggtagaagactgtagctatatatataaatatatagtaagttttttttttttaagagcaacagagagaagcagcctcctccctgctgcggtttcctatttatgtggccatgttcctcctggacggatctccctgtgtgtttcaagctgagagatgtgggctccggctggatttgggttttgtgggaggtgcaggggccaagagagacgtggtaggtctccaagagtcccacccgggggggaagaagcaaagccatctcccaccccctcctagccttctcatttctgctttcttactggactcatctttatatataatgttaataaaaaagacgaaaataaaaaaaaaaaaa

SEQ ID NO: 199 - DNA, 1405 bp, Homo sapiens
ctaaagccgcaggcgccgcggtaccctggctgtggccctcggcgctttcttcctagggtcacaggacccatacgagtgggagctccctgggagcagaactgcgtcttgtatcacctggcgcggtgaacgtgggggttgaaacgctccacgcggaaggtagagggcaggggccaagggggcgatcctggtggctgcgctttttgctatttgctgccgacggcatgcagacgagatgcaaataagcttatgaaactgtccgtcctaccccctcgctccctcctcgccccctacaccgtgttgtgctgcccaccagactcggagaagccgcggctgtccccggaaccctccgagcggcgccctcaggcccccgccaaaaagctccgcaagccgaggaccatctactccagcctgcagctgcagcacctaaaccagcgtttccagcacacgcagtacctggcgctgcccgagagggcccagctggcagcgcagctcggcctcacccagacccaggtaaagatctggtttcagaacaaacgctccaagtataagaagctcctgaagcagaattctggggggcaggaaggggacttccctgggaggaccttctctgtgtctccctgctccccacccctcccctccctctgggatctacccaaggcagggaccctgcccaccagtggctatggcaacagctttggagcctggtatcagcatcactcctcagatgtcctggcttcgcctcagatgatgtgaatctggggaagggcgggtcaggcccacagccttcctgcaaagcccaggacccaggcagtccacctgcaccccttctgggctgggaggaaaccagctccagatgggttttctctggaggacaagcagttagaggagaaaaaggaatggagcagagcctgtacccctaaccctaacagctaaatcaaggacctcagccttatataatcattgtccccaccactaccatggactggacaccttcactccagctggacaaagactctggagagagagccattggctggagttgagactgtccccagaacccttggtcttgccactcccccactccttcttccctctctccctttctcctctccctgctttcttgaaaaggactgaatcgccactacagcctgggtgcaaaatcagcaagaaacattgagtatttttttttctttgtatgcctttggccttgcacaacccatttgtgagcaaaagcagaagtggaccaccatcagctcccacccacccagcgatttttccttggaggtcagcccgttacccccataactgatttacctacttaccatactgggaggtagaagagatgcagagaaatgtggaatttgtggacctatgggtaatttatgctttcctcctaaaaaaaaaa

SEQ ID NO: 200 - DNA, 1424 bp, Homo sapiens
agcagtcagccggccggagacagagacttcacgactcccagtctcctcctcgccgcggccgccgcctcctccttctctcctcctcctcttcctcctcctccctcgctcccacagccatgtctgcttagaccagagcagccccacagccaactagggcagctgccgccgccacaacagcaaggacagccgctgccgccgcccgtgagcgatgacaggagtgtttgacagaagggtccccagcatccgatccggcgacttccaagctccgttccagacgtccgcagctatgcaccatccgtctcaggaatcgccaactttgcccgagtcttcagctaccgattctgactactacagccctacggggggagccccgcacggctactgctctcctacctcggcttcctatggcaaagctctcaacccctaccagtatcagtatcacggcgtgaacggctccgccgggagctacccagccaaagcttatgccgactatagctacgctagctcctaccaccagtacggcggcgcctacaaccgcgtcccaagcgccaccaaccagccagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtgaaaatctggtttcagaacaaaagatccaagatcaagaagatcatgaaaaacggggagatgcccccggagcacagtcccagctccagcgacccaatggcgtgtaactcgccgcagtctccagcggtgtgggagccccagggctcgtcccgctcgctcagccaccaccctcatgcccaccctccgacctccaaccagtccccagcgtccagctacctggagaactctgcatcctggtacacaagtgcagccagctcaatcaattcccacctgccgccgccgggctccttacagcacccgctggcgctggcctccgggacactctattagatgggctgctctctcttactctcttttttgggactactgtgttttgctgttctagaaaatcataaagaaaggaattcatatggggaagttcggaaaactgaaaaagattcatgtgtaaagcttttttttgcatgtaagttattgcatttcaaaagaccccccctttttttacagaggactttttttgcgcaactgtggacactttcaatggtgccttgaaatctatgacctcaacttttcaaaagacttttttcaatgttattttagccatgtaaataagtgtagatagaggaattaaactgtatattctggataaataaaattatttcgaccatgaaaagcggaa

SEQ ID NO: 201 - DNA, 1892 bp, Homo sapiens
atgatgaccatgactacgatggctgacggcttggaaggccaggactcgtccaaatccgccttcatggagttcgggcagcagcagcagcagcagcagcaacagcagcagcagcagcagcagcaacagcaacagccgccgccgccgccgccgccgccgccgcagccgcactcgcagcagagctccccggccatggcaggcgcgcactaccctctgcactgcctgcactcggcggcggcggcggcagcggccggctcgcaccaccaccaccaccaccagcaccaccaccacggctcgccctacgcgtcgggcggagggaactcctacaaccaccgctcgctcgccgcctacccctacatgagccactcgcagcacagcccttacctccagtcctaccacaacagcagcgcagccgcccagacgcgaggggacgacacagatcaacaaaaaactacagtgattgaaaacggggaaatcaggttcaatggaaaagggaaaaagattcggaagcctcggaccatttattccagcctgcagctccaggctttaaaccatcgctttcagcagacacagtatctggcccttccagagagagccgaactggcagcttccttaggactgacacaaacacaggtgaagatatggtttcagaacaaacgctctaagtttaagaaactgctgaagcagggcagtaatcctcatgagagcgaccccctccagggctcggcggccctgtcgccacgctcgccagcgctgcctccagtctgggacgtttctgcctcggccaagggtgtcagtatgccccccaacagctacatgcctggctattctcactggtactcctctccacaccaggacacgatgcagagaccacagatgatgtgagttgcccaagggaacaccctagggaaacgtctgaacaaggaaaagaggatccgggacctgcttgtatctgcgaaaaggagccaaaggagcaggcttaggagagctcataagtgtggcaagaagccgactaggctcattctctctccctctctctctctctccctctcctttctttttacttcttcctttcctccattccttctttctttccttttcctttctacctttcttttctttttgcctttcaccttttttctcatttaccttctctcttgagcaacgtcagtaattgatcttgcatctcagagagagagaaagagcatgtgtgagagagaaactggtttctatgccagcactcctgaaaccccttactgtaaggatattttctcttaccccttgggatccaggctctgagtctcttctctttgggagtatccatcaaaatgactttttttaaaaacagattttcccccaaccagaagaatctgcacaaacttggcagcgtttttacttgtttaatgagtttaagacattacatggtgaaagagaagcattttggactcctgcatttttatttaccattcccagactgacgagaaaaagaaaattcctcacataacagcccttctctaaagaaaaaggaaaaagtggctgtaagattagaacattgctacaaagggaatgctgcatgttttatcaaaatgcaatgaccaggaatgatggttgattaaaaaaaaacaaaacaaaaaccactctttccccaccccacccccccaaaccctgaactggaatcaggaaagacggaggaaacaatcaaaatcaccattctattgctttgacacctttactaggtgaattggtggcattcacaaagctaatagggacgtttatatcaagaaacatttctgtatatattgttgaattttagttgtacatatactttgtatgtttttgtcttctttcatatatggagtaaaagccacaaaacgctgaaaaaaaaaaaaaaaaaa

SEQ ID NO: 202 - DNA, 2229 bp, Homo sapiens
cctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgacgaggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgccgggagcaagaagtccccgcggctgcccaagtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtggccctgagaaggcagcaggcccaggaggaggaattgggtatcagccaccccatcccactgcccagtgcggccgagctgcttgtcaaaagagagaacaatggcagtaacccgtgcctcatgactgagtgcagtggcacctctcagccaccgccggccagtgtccccaccactgcagcttcagagggacgtatggtcatccaggatattcctgctgtcaccagcagagggcatgtggagaacacacctgacctggtttcagactccacctactacagcagcttctaccagccgtctctgtttccttattacaacaatctatacaactgcccgcagtactccatggccttggctgctgattctgcttctggggaggtgggaaatcccctcgggggatcccctgtgaagaacagccttcggggcctccccggaccttatgtgcctggtcagacaggaaaccagtggcagatgaagaacatggagaaccgccatgcaatgagctcccagtacaggatgcattcttactacccgcctccctcttacctgggccagagcgtgccccagttcttcacttttgaggatgctccctcttacccggaagccagggcgagcgtattctcgccgcccagcagtcaagattctggcttggtttccctctcgagcagctctcctattagtaacaagagcacaaaggcagtgcttgaatgtgagcctgcgtcggagcccagcagcttcacagtcactcccgtcatcgaggaggacgagtgagcagtgcctgctgccgatggcggttcacttggagtaacaggcttattccactttccatggggtttgttaatattttgcattgactcatactatcttaactgttgagaacgtatttggtttatattccttagagtttagtccagaggctgtaacacatttgtaatactttagggtccgtgactaccatctgcatggtttaagtgctttactcacggagtttaaataatagtgttcatttttttaatgacactggtttcatgtagttttcaagaaataaaagaattcattcaagtgaagccatttgtgtgcctctaaatgagtcatctaattagatgttacttttagttttaaaatgaaatcttaggtgccttaggggttttttttttttttaagtattttttaaaaacctgcaaagatataaatttagccaagttacctgacgggtgagaagaaaagagcaggcaaaattagtgatttttttagaagtctgctaaatggatatattgtgtgtgttgctgttggaaatagccccaccccatcctcccaatccaaaacgtaactgaaatataatcagaaacattaaagcctgtaaaaaaaaattgctgcgtttttggtaaagggtgtaatttgtaaacagtgcaatttaaagtgaccttagtgatgcagagttcctgagtggtgtttgtagaatgagtttatcatacattctttctactactggaaaaaaatggatgcagtctggactgttgtaaccttaggttgtaatctgatttggaaataagtacatctttaaaagttgctacagatttgagttcatgattttgttaaaaattgctatggagtactttgttatataacagaagccatcctgaaatgaaactagtctaaaaaaattcattgttctacttagttgcagctgtacctgaaataaaaatgttattgatgactgaaaaaaaaa

SEQ ID NO: 203 - DNA, 2944 bp, Homo sapiens
agactgaagccagtggcgctgcgctgaatgcaactgcgcgcgcccgccgggtgagccagcgatctgagccaggcgggggcggcccgacctttcccgcccagcctgggtcagaggaagccgaaagcggcctcagcaaggtgaggcgcccgaggctgcagaagaccgagcagaactttgcagagttcgggatgtgctgggctaggtcgctgaggacttgactggcttcctccctccttccctccacctaccttctccctccccctccaccatccagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaagttctccttggattattctacagctattatgtgtacataatgaaccatctttagaaaataaaagtgacatcagctctaggtatagatatattttttaataatgaaaaaagatgacatggataataataaaacattgattgatacaagataaatagtcttgtctcttaatgcgtagggggcctgggaagaatattaaaattttaatcaataaagtatgtctgttgaagcaagcaagcaaacaaatccataacaaccacaacaagcaacaagaacaagaacaacaacaagaagaagttgcagtatggatatctttcaccctcccaggaaactctttcaaacctaatctgtacttttgcatctgtataaaaatatcagtgagatggaactgtaaataattgttctgctgatctgtagtgttgctgttaccttctgggtttccacatttttattccgtagatgttaatctctttcatgtgcaatctttgcttcttgtaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagacccaataaaaaaaaaa

SEQ ID NO: 204 - DNA, 2184 bp, Homo sapiens
ccgcagccaggctgccaactcattcgggagcccggggcatgaacggctacggctccccctacctgtacatgggcggcccggtgtcgcagccgccacgggcgcccctgcagcgcacgcccaagtgcgcgcgctgccgcaaccatggcgtcctgtcctggctcaagggccacaagcgttactgccgcttcaaggactgcacctgcgagaagtgcatcctcatcatcgagcggcagcgggtcatggctgcgcaggtggcgctgcgccggcagcaggccaacgagagcttggagagcctcatccccgactcgctgcgcgctctgccagggcccccgccgccgggggacgccgtcgccgccccgcagccgccgccagcctctcagccgtcgcagccgcagccgccgcgccctgctgccgagttggccgcggccgccgcgctgcgttggactgccgagccgcagcccggggctctgcaggcgcagctcgccaagccagatttgactgaagaacgacttggagacggcaagtcggcagacaatacagaggtcttcagtgacaaagacactgaccagaggagttccccagatgtggcaaagagtaagggctgcttcacccctgagagccctgagatagtgtccgtggaggaagggggatacgctgtccagaaaaacggaggcaaccccgagagccgccctgacagccccaagtgtcacgcggagcagaatcacctcctgattgagggcccctcggggactgtttctctgcccttcagcttgaaagccaacagaccgccgcttgaagtgttaaaaaagatattccccaaccagaagccaacggtgcttgagctcatcctcaagggctgtggcggggacctggtgagcgccgtggaagtccttctgtccagccgatcctcagtcacgggagcagagcgaacttccgcagaacctgagagtctagcgttgccctccaatgggcacatctttgaacacaccttgagctcctaccccatctcgtcttccaaatggtctgtgggatcagcctttcgagtcccagacacgttgaggttttctgccgactctagcaacgttgtccccagtcccttggctgggcctctgcagccccctttcccccagccaccccggtacccgctgatgctgaggaatactttggcgagaagccagtcgagcccctttttgcccaatgatgtcaccctgtggaacaccatgacgctgcagcagcagtatcagctgaggtcccagtatgtcagtcctttccccagtaactctaccagcgtcttcagaagctcgcccgtccttcctgcccgcgccacggaagaccctcggatttccatccctgatgatgggtgtccatttgtgtcaaagcagtccatttacaccgaggacgactatgacgagaggtctgactcctcagactctagaacactcaacacatcatcttaaagtggtgctggatgggtggtggccaggtgacattttctgtgcgttttgaccctgaggcatctgaggagaggccacatcttgtgtatgccctttccttctgtttgacaaagtgactgtgcttgattctatacattagcaataaaaacataacttatttaacttcttgcacttcactggaaaatgccaaatagctctgttctgtggctttagtgctgaatgtttattgtaaaagagagtctaatgttaagaatagtcttgggaaggctgggtccgtggaagatttatttggggatgtaaagctgaaggtcagccttgcacctaaacccaacctggaatgttaaatgaaataatatacttgaatgcaattttgtaaaagtggattcctcaggatatgtgaaacctaaaggaagtggttctgttgcaaatggactataaacagggacattatattcttacactaaaaatccttgcattttaaagagagatgcacttaagaatagagtgaactgctcatatgcttatttaagcttggacagttttcagagacaaaccccattaagaattactcttttcacatggctgaatcgaaacatgtgtaatgtcaatgtaaaaccaatcacagctgtgaactgcatgaaatgtattgtgaaacgaacacaagattaagctttgtcaggttaatgtagcatgttaaggactctagaaaaaaataaactaaggagacgag

SEQ ID NO: 205 - DNA, 792 bp, Homo sapiens
gcgcccgctgtcgtaaccatggtgtggtgtcagcgctcaagggccacaagcgcttctgccgctggcgggactgcgcgtgtgccaagtgcaccctgatcgccgagcgccagcgcgtcatggccgcccaggtggcgctgcgcaggcagcaggcgcaggaggagagcgaagcccgggggctacagaggctcctgtgctcggggctctcctggccccccggtggtcgggcatccgggggcggcggcagagccgagaatccacagtccacgggcggccctgcggcgggggctgcgctgggactgggtgccttgagacaggccagtggttccgcgacccccgctttcgaagttttccagcaagattatcctgaggaaaaacaagaacaaaaagagagtaaatgtgagtcatgccagaatggacaagaagaactgatctccaaatcccatcagctttacctaggatcatcttctaggtctaatggtgtcattgggaaacaaagtatcgggtcatctatttcagaatactccaacaagcctgatagtatcctgtctcctcatcctggagagcaatcaggaggtgaagagagtcccaggtccttatcatcctctgatctggaatcaggaaatgaaagtgaatgggtcaaagacttgactgcgaccaaggcaagccttccgacagtgtcctcaagaccaagagatcctcttgatatccttactaagattttcccaaattacaggcgcagccggctagaaggcattctacggttctgcaaaggggatgtggtccaagccattg

SEQ ID NO: 206 - DNA, 1692 bp, Homo sapiens
tgttgctgcgggcagccgagaagtacccgcggacccccaagtgcgcgcgctgtcgcaaccatggcgtggtgtcggccctcaagggccacaaacgctactgtcgctggaaggactgcctgtgcgccaagtgcacgctcatcgcggagcgccagcgtgtcatggcggcgcaggtggcgctgcgcaggcagcaggcgcaggaggagaacgaggcgcgcgagctgcagctgctctacggcactgccgaggggctggcgctggccgccgccaacggcatcatccccccgaggcccgcctacgaggtcttcggttcagtgtgcgccgccgacggcgggggacctggagcgggagcgcccgcggggaccggaggcggagcagctggcgcagggggctcagaggccaagttgcagaagtttgacctgtttcctaagacgctgctgcaggcaggccgcccgggcagcccgctgccgccgccggtgaagcccttatcacccgacggcgcagactcggggcccgggacgtcgtccccagaggtgcggcccggctcaggctcggagaacggcgatggcgagtccttttctggttcgcccctagctcgggcctccaaagaggcaggtggcagctgcccaggcagcgctggccctggcggcggcggcgaggaggacagcccgggctccgctagccctctgggctctgaatccggttcagaggctgacaaagaagagggtgaggccgcgccggcgccagggctgggcggaggctcgggtccacggcagcggacgccgctggatatcttgacacgcgtgttcccaggccaccggcgaggcgtcctggagctggtgttgcagggctgcggcggcgacgtggtgcaggccatcgagcaggtgctgaaccaccaccgtgggggcctggcggccggcctgggccctgcggcgcccccagataaggccgccgtgggtgctgcagcagctgcagacgacgcgtggcccagccgcgtcgacgccgccgccgccgccgccgccgctgccggggggcctgggctgcctgcgccgctgcaggcggggcccgccgcacctccgcaccacagacccttgctggccggcgccatggcgcctggggcgctgggctcgctgagcagccgctcggccttctcgccgctgcagcccaacgccagtcacttcggtgccgacgcgggcgcctacccgctgggcgcgccgctcggcctcagccccctgcgcctggcctactccgcggcggcggcgcacagccgcggtctggccttcatggcgccctactccactgccggcttggtgcccacgctcggcttccgcccacccatggactacgcctttagtgatctcatgcgtgaccgctcggccgccgctgctgcggcggtgcacaaggagccgacctacggcggcggcctgtacgggcctatggtcaacggcgctccggagaagcagtagggcgaggggcctggcagccggccggtccccaaacaggaaccccagccctcttcccgcgggccatcgacccctcttcgcccagcgctctctctgcgccctggctgggggtcttctcactctaaggtggtttttgggttttgtttaggagggtgggtggggaaggctgagcaaagggggagcagctacagacaggtgcaggtgttctcggagggggtgcgcggcctgggtc

SEQ ID NO: 207 - DNA, 1907 bp, Homo sapiens
acttgctctgcagctcccagaggtggtggttgtgttacgaaggctgaccctgccaatggccgacaaaatggtgcgcacccccaagtgctcgagatgcaggaaccatggcttcctggtgcccgtcaagggacacgcgggcaaatgccgctggaagcagtgcctctgcgagaagtgctacctgatctccgagcgccagaagatcatggccgcgcagaaggtgctcaagacgcaggccgccgaggaggagcaggaggcggccctgtgtgcgcaggggcccaagcaggcctccggggctgcggccgccgcccccgcccccgtccccgtcccggccgcgagcctccgcccgctgtccccggggactccctccggagacgccgacccgggacccgagggccgcgcggccgcttgcttcttcgagcagcccccgcggggccggaaccccggcccgagagccctccagccggttctgggcggccgcagccacgtggagccgagcgagcgagccgccgtggcgatgcccagccttgcgggacccccttttggggcggaggccgcaggcagtggctaccctggccccctagacctgcgcaggccgatgcggaccgtgcccggcccactgttcaccgactttgtgcgccctctgaacatcaacccggaccgtgcactgggccctgagtaccctggtggctccagcatgcacccctactgcccgttcccgctgggctacctggacgcccctcctggcgtccccctgcagcagggcttccggcatgtgtcccgcagccagtaccaaggcggaggcttggtgtcagaaccaggaggagacttccagccaagctactacctgccgccgccgccgccgccactgccgccccttccaccgcttccaccgcagccccagttcctcccgccaggctacctctctgcgctccacttcctccccccgccaccgccaccaccacctccatcatctttctcactgaccgtcctgtttgatactgacaaggagaacactgatgaccaggatgcagaggtactgtcgggtgagcccagccagccatcgtctcaggagcagtccgactaggccccaggcccgccctcctggccagcagagtggggcactggggggcaacagcaacagttttcctgtcttcattcagtgatatgtagggaggaaggaggttgatagcatagatggcaactgattcccagtttaagataggaggaaggagagcaatttctaagtttcaatcctgcgctgtacagttgaagaagagtgtggaggaagctattaccaggggagggccagggctctgaggagtgggcgctgggagaagctcccatttaggaatgaatttaactgtccttgggttacactaccatttattggaacaagccccagaggcagtatttgatttcctcaggccccactctaggacaggaggcaccatctatttcagccttctgctgcctttgcctggtcctccaggttgctgggggcaccacagacatcaagattccagttcatccaggtggctggagccagcagccaggaccagggtcgttgacagcaggttctgcagcatcctgccttgctgctctgtcccccacatcttcctggccacagccccttgcccctcctctaaggggttttactagcaagcatcctggctgctggggctacttcattccccctccataaagtttcagccattatgggcactggttttaaaaaatttattagtttgactatttgatggttttatagtgattgccaactttaaaaagtaggctgttcataagcactgatgcagtccctagggaatagaatggtgcttctgatcacctgtgacatgaacagtttcttctgtgaggacagttggctattgaaataaaatgagcaatgg

SEQ ID NO: 208 - DNA, 1575 bp, Homo sapiens
cctcctcctgctcctcctcctcctcctcctcctcctcctccttctcctcctcctcccggtctgagggcggcggtctccgactcaagaccctggggctccgggtcttcttagcagccgccgcagcagccgcggcgacgtcactgtcctctcggcctggcacacagcgctccggccgccgaatgcccgtggacgcgcatctcttcccagagttcctgcttcctgggccagccaaagccgcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtgaccttggagcagcaactggtttctccttctggggatccccacagggcccctgccctgcccagcatatgctcaactctgatcctccagccctgtgccacccttgaccctcttctactgcagccacaggtcctgggaaagtagtggggtccagaaccctgggaggggcggagtttagtggatgggaagagcagaaggccttggtgggggtgggggaggaggttgagggaacagggggctgaaggggcacttgtcgtattgggaagaggtgtagtttcccagtgcctattctctcatgcactttcctttccaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgttgttgttataaggcaaaaaaaaaaaaaaaaaaaaaaaaaaaaaaaaaaaaaaaaaaaaaaaaaaaa

SEQ ID NO: 209 - DNA, 2857 bp, Homo sapiens
gagagaggcgatgcttgaagttcattggtctttgtgagacaggatccatggaacccagtgacatgcctgctggctaccactgccccttagactctgccccctgggatgagaccagagacccccagagcacagagctgatccccaggagagccatcagccgctctccaacctgcgcccgctgccgcaaccatggtgtcaccgcccatctcaagggccacaagcgcctctgcctcttccaggcttgcgagtgtcacaaatgtgtccacatcctggagcgccgcagggtcatggctgcccaggtggccttgcgtaggcagcaggaggcgcagctaaagaagcacctgatgaggagaggggaagcctctcccaaagctcccaaccacttcagaaagggaaccactcagccacaggtcccctctggaaaggagaacatagcaccccagcctcagaccccccatggggcagtcctgctggcaccgacaccccccgggaagccttgtacccaactccagcctgtgccctctgcccctgcagaactcctgtgggcctctgctgctcagccatcccccggaagcctcgcccttgtcctggactccggtgcctcctggcccttgggtccctggacactggctgcctccaggcttctccatgccaccaccagtggtgtgccgcctgctgtaccaagaacctgctgtctctctgcctcccttccctggctttgaccctggcacctccctccagctgcccactcatgggcccttcaccacctgcccaggatctcacccagtgctgacagctcctctttctggagagccccaagggccccctagccagccccgcacacactcaactctgatactccagccctgtggcaccccagaccctcttcagctacagccacaggtcctgggaaagaagtgggatctagggccctgggaggaggttgagcctggggaaggaaaaagcaggaaactgaaggaagcaggggctgaggaacacttagagggtgggcagaagcgggggttcccagtctgcttgtctccctttcccttgcaggcctctggagcctcgtgcctggcccggacatctggcccctcagagtggcagctgcagcaagaggcagctgaagccctcgtggggctgaaagattcatcccaggctcctcgtgtgaccccttctgtgccccccaaccctgcctggatctccctgcttcacccctgtggcccaccaggtgggccatgaaaggggaggatggatagggatggctgggaaatggagatcactgaagtacacagggactaaccaaggagatgagggggtcgacaggttgaacgtcttcaggcccaggaccccaagctcctcagcctggcccctgggattgcagttgagagttattcagtgaatcctttttatcagtttggcactcgacagcaaatttcttgatatcaaggaaagtggggcactgagaaaggcagggacttgcccaagggcatatagtgagacagtggcagggaacccaatgctctgtctctggacccaggctgcctgctgaagtctgaagtggggtctggcctgggaggaggtctgataagtgccttcaaggagcttacgttctagttagggaaattggatgccttcacaaggctcagtgacaaacctgaagaagattggaggaaccttgaagagtgagaaacacctagggggacagacagggaaagctgcgaattctcttgtccaaatagtggattgggcagactggcctggaggaaatgctagagcagagggaaaggaggctggagaggcttctgatggtggagatctggcatgccaggcttaggtgtctagaacagcaactgtatgtgaaggggagccagggaacgtttctgaactaagcaaggacaaattcagagaccctgagctttagaaagacaagtgggtggctttgatggacggtttggaggaggcaagactggaggtgggaaaattagcaaggaggtctgtgaaataatccaggagaacaatgatgaggcctggattggattcggtaaaaagagggggttgctagaaggaaaaacaggtgtgacctgatcctgccccttccttcttgcctgtagctcctgctggaggaagaggattccagcctgttggcccctgtcttcgacccagcccagccccctctgttgctctgcatattggccgtctggggtccatctccctcctgagctagaaacccagagatggaggctgtcttgctatggcagggaggtgacagcctgctggcactgtatatttagtgtcttacttaaggatttatgcatggaatttaatgtagtacaagcttcgggcttttttgtttgtttgtttgtttgtttgtttaagctttcaggtgcttcattagctttcagttcctttggtagtgtgggcatttccttggctgacagtggatattcttgtacccttcttgggtcctgggatctcttgaaatccccaataaagagagagttgtgctatttaagctgaccagtatctataaacgtgtttgcatgagtttacatcccaggattccatgattctgtaaatgcctatgcattcatgtctgtctccatgcatgtgaaaacaggagagtgttttcattttgtgtctaggtttgtgtgagtaagcaagaaataaacctttgttgttgtaagccactgagatttggagagtgttaccacagcctaacctagtctatcctgactgacagaaaggacttgttcatttcgcttctcaaagtgaaaaatctgttatccaatagctaccatagatgaaaacaaacttggatttttttctttgtccaaataaaaaaaatgatgtaaag

SEQ ID NO: 210 - DNA, 4052 bp, Homo sapiens
aagtaagtgcgatggaaccttcaggttccaaccgccgccagggccgctccgcccagtggagcctgtccggcccccttgctgcccgctagctcccgccggctggcgcaagctgtcggcgccggggcactgcgggcggggtcggagcctggccttcctgacgttgcagctgccgtccccgcacgttccggccagggcctccctcttagggccgggcggtgcccgtggctcaggctgcagagtagaaagcacaaaaaccagcctgattgtatctggaaaaaaccattatgttacagttgataggctcaccccaaaatatgcttttggggactgatttagcacctgcatattctgcgtgaatctctttaattggttgcagttgagctaatggtggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaagatgcaaaaaaaaaaaaaaaa

SEQ ID NO: 211 - DNA, 3222 bp, Homo sapiens
gagcggcttcctgcaaaccttccctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcggcagcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatataggtggtacttttgaaacaattacattggttctcttggtttaactgaggtttatgaatattcaaacctttgctgggggaaagaaatgaaagttaatgagcatgcttgctatgagagagggatttttaatttaacttgtagttatagtttacttattgtttttagaattacttttacattttcccaactagatggcctagagtccaacattaccttttgagatgacattattgtctccataattgagtgatagctttaaaaaaaagattagttttgcttaagaagttatgttacaactgatcagccctatatgaattaactgatcagccctatatgaaacataagttgtgttataacttatcagccgtatatggaacataaatagtttctacctgcttgttagagaagctttaatttggttctaataaatacagtatggtagtgtttataggaatccaggatgttgaagaaatggcataatgtctatattttggaaacagaaaggaaaagtcacttaagatagtattaagtaattaaattcctatgtcagttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgttttaagttgaagttacttcatggatgtcatacccatgaagtgcatttggatgagatagaagaaattgttttttaaaaagtttaagtaccaaaggtagtctagtctagaacgataagttaatacgtgttggcttttctaatttgtactgtaacatccttatactttctattttaagtatatctgtttcttaagtaaacaacttagatattttccacacctttttttttttttctgatgcagagttcaggttaatattttactgcatctgataatgtattatacgtttgaagcctagtgacttttcattttgacattcttgtgatttcatatgctgtattcttcaagcaataaaattgtgatgtgttttataaaaaaaaaaaaaaaa

SEQ ID NO: 212 - DNA, 1022 bp, Homo sapiens
gggcgggagcggcggtccagactggggagggacgcgcaccggccaggaggcttcaagaggagggcactagggccctgcgagcggcgtcttaaccggcggcgctaggactccgcgggaaacggcgggggcggagcgggcggcaccaggacccaggggaaccgcgacgggcgggcggcgagcaggcccgggagccgggaggctgcgggcggcggcgctggacccgacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctcccgggcgctcgagctcttcctagagtcgctgttgaagaaggcctgccaggtgacccagtcgcggaacgcgaagaccatgaccacatcccacctgaagcagtgcatcgagctggagcagcagtttgacttcttgaaggacctggtggcatctgttcccgacatgcagggggacggggaagacaaccacatggatggggacaagggcgcccgcaggggccggaagccaggcagcggcggccggaagaacggtgggatgggaacgaaaagcaaggacaagaagctgtccgggacagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaaagggaatctcagtgtctgttccaggctctgcgcaggaaaaaaaaaaaaaaaaaa

SEQ ID NO: 213 - DNA, 2823 bp, Homo sapiens
acgcggacgcggctggcggctcggtttctgcaaatgcgtgaatgagccggatgccagcctctgtcccctggagcccagcgtgaggaagaggcatgccccatcagccttcagcttgagcccggcggcccccgcccccgccccctgccaccctgcactgccccggctcccccgcggcccccacgctgcagtgcggccgggccccctccccgcaggggccgcccccgccgcccacccctagcgcccgtggtggtggtggtggtggtggtggtggtggcccgggccgcagggccatgaaactacaggccgtgatggagacgctgttgcagcggcagcagcgggcgcgccaggagctggaggcccggcagcagctgccccccgatccccctgctgcaccccccggccgggcccgggctgcccccgacgaggacagagagcccgagagtgcccggatgcagcgggctcagatggccgcactggcagccatgcgggctgcagctgcgggcctgggacacccagccagccccggcggctctgaggatgggcccccaggctcggaggaggaggacgcggcccgggaggggacaccgggctcacccgggcgaggcagagaagggccaggagaggagcactttgaggacatggcctccgacgaggacatgaagcccaaatgggaggaggaggagatggaggaagacctcggggaggatgaggaggaggaggaggaggattacgaggatgaggaggaggaggaggacgaggaggggctgggccccccaggccctgccagcttgggcaccacggcactgttcccccgaaaggcccagccaccccaggccttccgcggcgatggcgttcccagggtgctggggggccaggagcggccggggcctggccctgcccaccccggaggggccgcccacgtagccccgcagctgcagccgcctgaccacggcgactggacttacgaggagcagtttaagcagctctacgaactcgacggggaccccaagaggaaggaattcctggatgacttgttcagcttcatgcagaagcgagggacacctgtgaaccgcatccccatcatggccaaacaggtccttgacctgttcatgctgtacgtgctggtgacggagaagggcggcctcgtggaggtcatcaacaagaagctgtggcgtgagatcaccaagggcctcaacctgcccacgtccatcaccagtgcagccttcaccctgcggacccaatacatgaagtacctgtacccctacgagtgtgagaagcggggcctcagtaaccccaatgagctccaggcagccatagacagcaaccgacgggagggccggcgccagagctttggtggctccctctttgcctactcgccaggcggggcacacggcatgctctcctcacccaagctacccgtgtcctccctgggcctggccgcaagcaccaatggcagctccatcacccccgcccctaagatcaagaaagaggaggactcagccatccccatcacagtccctggccgcctgcctgtgtccctggcgggccaccctgtggtggcagcccaggcagcagctgtgcaagcagcagccgcccaagcagctgtggccgcacaggcagctgccctggaacagctgcgggagaagctggagtctgcagagcctccggagaagaagatggccctggtggccgatgagcagcaacggctgatgcaacgtgcactccagcagaacttcctggccatggcggcccagctgcccatgagcattcggatcaacagccaagcctccgaaagccgccaggactctgctgtgaacctgacgggcaccaacggcagcaacagcatcagcatgtcggtggagatcaacggcatcatgtacacaggagttctgtttgctcagccgccggcccccacgccaacctctgctcccaacaaaggaggcggcggcggcggcggcagcagcagcaacgcaggcggccggggaggaaacaccggaaccagcggcggccaggctgggccagcggggctgtccacaccctccacatctacctcaaataactcgttgccttaaccgcatcactccccacccgccacccaccctggagcccgccggcctgggcagggggtccaggtgggccacacaggggccaggatggcggaagatacgggtggggagggaagatatccagaaaggagccacagctgacgccaaaaagaaaagaaaaaagatatatatatatatatatatatatacacgtatatatataaagagaatttaataaaacaggggaaaaccaaggaacacttgaatttctcaggttttggacattcagagagatgaattgtgagaacagcaaagaaatccatcagaaaaacagaaagaggcagacgtttcccagggcgttcaggcagccctgatggaccgaaggctctggtgtctggtttggccccacagcagtgtgggccgatcctgtttacctcatacatccctgcactgtgtgttttcatttttgtctgctttagttctcttttattttctattcaccacacactcaccactcccagcttctcgtgtccagtgaaacccctgaaccaagatcactgaatttttgtttttttcttgttgctttgggaaatttttttttctctgtagggtttttaagaggtttcgggggttttgttgtgtaaatattctattttattcttggggggatcaaaccttaggaaaaggatatctatatatctatatagctatatatttgtgttccttcagggaaactggtcttgaaaaagcaagaaaaaaaagcaaaaaaaaaaaaaaa

SEQ ID NO: 214 - DNA, 4253 bp, Homo sapiens
ttccggtgcgggccccgccccggctgtggcccccggctgcggaggagtccgagacgcagctgccgcgccggggcctgagctgccgcctcctccgccgcccgaaaacccggagtgccccgcacaggtttagacccagtgtgcctggtgggctgtgcccaggttcagagtcatgccactctgtgggtgaagcttgaggcaaaaatggagccacttcagcagcagcagcagcagcagcagcaacaacagaagcagccacacctggctcctctgcagatggatgccagagagaagcagggccagcagatgagagaagcccagttcttgtatgcccaaaagctggtcacacagccgactctcctttccgccacagctgggagaccttctggcagcactcccttaggtcccttagccagagttccacccaccgcagcagtggcccaagtgtttgaacggggcaacatgaactcagagcctgaggaagaggacggaggtttggaagatgaggatggggatgatgaagttgcagaggtggctgagaaagaaacccaggctgcttcaaaatattttcatgtgcagaaagtagctcgccaagatcccagagtggcacccatgtccaatctacttccagcaccagggctcccaccacatggacaacaagctaaagaagaccataccaaagatgcttccaaggcctcaccttctgtctccacagcaggacagccgaactggaatctggatgagcagctcaagcagaatggtggtttggcctggagtgatgatgcagatggaggccggggaagagagatctctcgagattttgccaagctgtatgaactggacggtgatcctgaaaggaaagagttcctggatgacctcttcgtctttatgcagaagagggggacccccatcaaccgaatccccatcatggccaaacagatcctggacctgtacatgctgtataagctggtgaccgagaagggaggcctggtggagatcatcaacaagaagatctggagggagatcaccaaaggcctaaacctgcccacatccatcaccagcgccgccttcaccctcaggacgcagtacatgaagtatctgtatgcctatgagtgtgagaagaaagccttgagttccccagccgagctccaggcagcaattgatggcaaccgcagggagggccggcggcccagctacagctcctccctctttggctactcacctgctgcggctactgctgctgccgctgccggggcccctgcccttctctccccacccaagatccgctttcccatccttgggcttggctccagcagtggtaccaataccagtagccctcggatatccccagcaaccactctcaggaaaggtgatggagccccagtgacaacagtgcctgtgccaaatcgtctggctgtgcccgtgaccttggcaagccagcaggctggtactcggaccgccgcactggagcagctgcgggagcggctggagtcaggggagcctgctgagaagaaggcatcgaggctgtctgaggaggagcagcgcctggtgcagcaggccttccagcgcaactttttcagcatggcacggcagctccccatgaagatcaggatcaacggcagggaagacagagcagaggcctcggctgcagcactgaacctgaccacgagtagcattgggagcattaacatgtctgtggacatcgatggcaccacctatgcaggtgtgctgtttgcccagaagcctgtggtccacctcatcacggggtctgctccccagagcctcggcagcagcgccagcagcagcagcagctctcactgttcaccaagtcctacctcatcccggggcacccccagcgcagagccctccaccagctggtccctctgatgggcaggacccagcttcccacttgccactctcctgtcgagagtgaaggaagttgatgcacagaatttacctcatctcacagagcccacgtcgacgagcaccatttggccagacattgagagtttggacgtgtccgtctgtccaggctccattcaggtcctgctgtactctgggggcagggagaggctagaggggcaggacagacagcgttgtccaatcagggattgtcctggagaactgggtgggggtctgtgggtgtccagcttcctccagggttccccagccacctcccagctcagggcacagtgtatcgacaatctgtcagccgacgcagggctggaggccctccatttccctccccttttaatttatttccctgaccctgccttctgccatgaccccagggccactagtctcttcccctgtttttaagtcccatgtggggctgccaggagccaagagcatgccttcatgcccttctctgcagagcatgggatggggcccttccagcccactttgcctactgttaggttcctggggtacgggtccctcaaacacaagtcttgaatcagtcctcagggccccagatcccccttctaatagtctgaaggaagaggctgtgagggcagttcagggccagggcccacagggcatctgctgatgggaaggcagagcctcggggctgcccagccctggcacctgcttcacacggaccattctctgaccgcccccgccaaacctcatgctccccacttgcccttattggcctgctttcccaaaaacagcccactcatcctttccccagccctcttcagccctccccagtcctccccagccttcttcagccttcttcagctcagccctcttctatttcttatggggccatcttggcctcaccatccccacacgtgccgatgtcaggttcattgaaatacctcagatttgtaattgttgatgtttgagtcttcaggaagtatttgcatctctgaaatcttttttatatgtgttttgctgacttttgttttttttttattttaaaatttttatcgtagcaccaaagaaatgaaaacagatcacccccaaagccaagcaagtgattgggtaacccggcccctctggcccttccctcaagcccagtgaggaggtgggtggaggcatgcaggggagacgactcagggatcgcgggggcggggaggtggagtggagaggcccgctctcacaccgggtcgggccctgaaactgtaccagttctgaagaccgttttctgccacacccccacccccagctgaccagggaggcagaggacacctccccatcactcagcattcccagctcagggcacaggcaggctggggtcctcgctggccttgccagaggttgagccgccccagggtatgaggagatgaataactccacagctcctcctggaccctgcgcgggagcaggcagctcctgtgctgtaaagaaaattgattcgcttgcggctcacctcagtcgaggaagccctggaatgttcagcagaacaccaccactgtgacatggggctgtggcagtgggagacaccgcgcgtggcgtgggtgtgtgtggcagcgtggctcgcattcagtcctgtgtaggagaggaaagggaatcaaaagcttgagcacaaacagatacctcagcccggtaagctgcagctctgctcaactgcgtcttctctcagccctccacacacactcacccccactcccacacacatacacacacacacacacataccccatctcccgagggctgacctcctctggcctcagcctgcagggtgtgggcagagaagggcatctgggacgtggtgccagtgaggagcccagttggctggcactgggcccatttgaaggtgtctcagacatttggccagtatgtctttctcaggggtttggtcacaaaggatggactcttcccacccagaggatgcagggaaagcacactgtgtctttccggtcattggatcctctccctttccccaggcagctcgcctggccacaccgttggagtgaaccctcactgccctcaaggacaacagcagggtgtcacccagagcccgatgaggggtgccagcaggtgcccccacgagtggggccttggcccaagcagagcttcccctgaaggtgccatcagccagggcagctctgtcccctcctgctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcacacaaaaaaaaaaaaaa

SEQ ID NO: 215 - DNA, 4360 bp, Homo sapiens
cgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaaaaaa

SEQ ID NO: 216 - DNA, 1986 bp, Homo sapiens
agtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaaaaaaaaaaaaaaaaaaaaaaaaaaaaaaaaaaa

SEQ ID NO: 217 - DNA, 2614 bp, Homo sapiens
ctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgagctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttttgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagtgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaagaagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggtccctggctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagcc

SEQ ID NO: 218 - DNA, 1227 bp, Homo sapiens
caggcctcctggcagcacctgcgcagtgaacaggctggctgaggtgcacgggagcccgcccgcctctctctgcccgtgtcagtccgtgaaattccggccggggctccctgagatggccctcctgacagctttggacgacaccctccccgaggaagcccagggaccgggaaggcgaatgatactcctttcgaccccgagtcaaagtgatgccctgcgagcctgctttgagcggaacctgtacccgggcattgccaccaaagaagagctggcccagggcatcgacattccggagcccagggtccagatttggtttcagaatgagagatcatgccagttgaggcagcaccggcggcaatctcggccctggcccgggagacgtgacccgcaaaaaggcagacgaaagcggactgccatcaccggatcccaaaccgccctgctcctccgagcctttgagaaggatcgctttccaggcattgctgccagggaagagctggccagagagacgggcctcccggagtccaggattcagatctggtttcagaatcgaagagccaggcaccggggacagtctggcagggcgcccacgcaggcaagcatccggtgcaatgcagccccaattgggtgacaccctgctctctcgtgggtcgcctttgcccacactggcgcatggggaaaggggcttcctgcaccacacatgctctcccacagtgggctttcgtgagccatggattgagggccgtccctgtgctcctgcccagccaggccgcgcaggcagaagggatctcccaacctgccccagcacatggggattttgcctacaccgcccaggctcctccagaaggggcgctctcccacactcacactcctaggtggcatccacacaagggcaaaatccggaaggactgggacgcgcagcgcgacggccttccgggcacttgcgcggtgggacagcctgggccctctcaagcggggccacagggccaaggtgtgcttgcgccacccgcgtcccagggaagtccgtggtgggggtggagcaggggtacccaggtcgccggtgtggcgtggaacctcaagcaggggcaattccacctcaccagcccacgcccccagaggcctccacacggcaggggcagatgcaaggcatctcagcaccctcccaggcgctcctggagccagggtgctcgtctgcactccactccatcctgctgctggatgagctcctggcga

SEQ ID NO: 219 - DNA, 243 bp, Homo sapiens
atggccctcccgaaaccttcagacggcaccctccccgcggaagtccagggacggggacagcgaaggagactcgtttggaccccgagccaaagcaaggccctacaagcctgctttgagcggaacccgtacccgggcatcaccaccagagaacggctggcccaggccatcggcattccggagcccagggtccagattctgtttcagaatgagaggtcatgccagctgaggcagcactggcattaa

SEQ ID NO: 220 - DNA, 594 bp, Homo sapiens
atgccggctgaggtgcacgggagcccgcccgcctctctctgcccgtgtccgtccgtgaaattccggccggggctccctgcgatggccctcctgacagctttggacgacaccctccccgaggaagcccagggaccgggaaggcgaatgatactcctttcgaccccgagtcaaagcgatgccctgcgagcctgctttgagcggaacctgtacccgggcattgccaccaaagaacagctggcccagggcatcgacattccggagcccagggtccagatttggtttcagaatgagagatcatgccagttgaggcagcaccggcggcaatctcggccctggcccgggagacgcgacccgcaaaaaggcagacgaaagcggactgccatcaccggatcccaaaccgccctgctcctccgagcctttgagaaggatcgctttccaggcattcctgccagggaagagctggccagagagacgggcctcccggagtccaggattcagctctggtttcagaatcgaagagccaggcactggggacagtctggcagggcgcccacgcaggcaagcatccggtgcaatgcagccccaattgggtga

SEQ ID NO: 221 - DNA, 1617 bp, Homo sapiens
ccaccccccccccccaccaccaccaccaccaccaccccgccggccggccccaggcctcgacgccctgggtcccttccggggtggggcgggctgtcccaggggggctcaccgccattcatgaaggggtggagcctgcctgcctgtgggcctttacaagggcggctggctggctggctggctgtccgggcaggcctcctggctgcacctgccgcagtgcacagtccggctgaggtgcacgggagcccgccggcctctctctgcccgcgtccgtccgtgaaattccggccggggctcaccgcgatggccctcccgacaccctcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagagggggtctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggttgggacggggtcgggtggttcggggcagggcg

SEQ ID NO: 222 - DNA, 594 bp, Homo sapiens
atgccggctgaggtgcacgggagcccgcccgcctctctctgcccgtgtcagtccgtgaaattccggccggggctccctgagatggccctcctgacagctttggacgacaccctccccgaggaagcccagggaccgggaaggcgaatgatactcctttcgaccccgagtcaaagtgatgccctgcgagcctgctttgagcggaacctgtacccgggcattgccaccaaagaagagctggcccagggcatcgacattccggagcccagggtccagatttggtttcagaatgagagatcatgccagttgaggcagcaccggcggcaatctcggccctggcccgggagacgtgacccgcaaaaaggcagacgaaagcggactgccatcaccggatcccaaaccgccctgctcctccgagcctttgagaaggatcgctttccaggcattgctgccagggaagagctggccagagagacgggcctcccggagtccaggattcagatctggtttcagaatcgaagagccaggcaccggggacagtctggcagggcgcccacgcaggcaagcatccggtgcaatgcagccccaattgggtga

SEQ ID NO: 223 - DNA, 3227 bp, Homo sapiens
agtggaaatgcgtcatagagggcgggcggcgacggcggtggcggcgtcggaggcgcctccgggggacggtggcggctcccggcggtgaggccgcgcctgtccggggatcgtcgagggacggcgggagcttgggccagcggcggcggcggcctgggacgcaggcggagccccgcgcaggcccaaggtcccggaggctatggcagcggctaccatcgtgcacgacacgtctgaggccgtggagctctgccctgcttacggcttgtacctgaagcccatcaccaagatgaccatcagcgtggcactcccgcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctggtcaagtcttttctggcctgcctggacggcaagaccatcaagctcagcggcttctccgacatcctgaaggtgcgcgcggccgagttcaagatcgacttccccacccgccacgactgggactccttcttccgcgacgccaaggacatgaacgagaccctgccgggggagcggccggacaccatccacctggaggggctgccctgcaagtggttcgccctgaaggagtcgggctccgagaagcccagcgaggacgtcctggtcaaggtgtttgagaagttcggggagatccggaatgtggacatccccatgctggacccctaccgggaggagatgacgggccgcaacttccacaccttcagtttcggggggcacttgaacttcgaggcctatgtgcagtaccgcgagtacatgggcttcatccaggccatgagcgccctgcgcgggatgaaactcatgtacaagggcgaggacggcaaggccgtggcctgcaacatcaaggtttcttttgattcgaccaaacacctgagtgatgcctcaattaagaagcggcagctggagaggcagaagcttcaggaactggagcagcaaagagaagaacaaaagcgcagagagaaggaagcggaggagaggcagcgagcggaggaaaggaaacaaaaggagctggaagagctggagcgagagaggaaaagagaagagaagcttcgcaagagggagcagaagcagagggaccgtgagctgcgccggaatcagaagaagctggagaagctgcaggcggaggagcagaagcagctgcaggagaagatcaagctggaggagcgcaagctgctgctggcccagaggaacctgcagtccatccggctcatcgccgagctgctcagcagagccaaggctgtgaagctacgggaacaggagcagaaggaggagaagctgaggctccagcagcaggaggagcggcggcggctgcaggaggccgagctgcggcgcgtggaggaggagaaggagcgcgcgctgggcctgcagcggaaagagcgggagctgcgcgagcggctgctgagcatcctgctgagcaagaagccggacgacagccacacacacgacgagctgggcgtggcacacgccgacctgctgcagcccgtcctggacatcctgcagaccgtgtcgtccggctgtgtgagcgccaccacgctgcaccccctcgggggccagcccccggccggtgcccccaaggagagcccggcccacccagaggccgacggcgctcccaaaagcgtgaacgggagcgtggccgaggaggccccatgcaaggaggttcagagctcctgtcgtgtggtccccgaggatggctctccagagaagaggtgcccgggcggcgtcctctcctgcattcctgacaacaaccaacagcccaagggcatccctgcctgcgagcagaatgtctccagaaaggacacccggtcagaacaggacaagtgcaaccgggagcccagcaagggccggggccgggccaccggagacgggcttgctgaccggcacaagcgggagaggagccgggccaggcgggccagcagcagggaggacgggaggccacgcaaggagcggcggccccacaagaagcacgcctacaaggatgacagcccccgccggcgcagcacgagcccggaccacacccggtcccggaggtcccacagcaaagacaggcaccggagggagcggagccgggagcggaggggcagcgccagcaggaagcacagccgccaccgccgccgaagcgagcggtcgcgctcccggtccccgagcaggcaccgcagtacctggaacaggtaatgacgggcacggcctccccacggcctgtccgggaaagaccaggacctgctcgagcctcctggccgctccttggccgctctccgtccacccctgcaaagccaagacccttctgcagccacgaatgtccacggagcccgccggcaggaaggaagacaccatgctttagagatccatctttctccactcaccgcagcgtacttggcacttcagtttcaaacacgtagtcctttaaaacttgatccgatagctttaatgcggccggtcctctctcagtcaggaaaattgcacagaccgacagtcgtgaggatggcagagctgctgcattcccccacacggggatttctgtgtctgcttggcgacctccctgcgtgcacggcctaggaggtgcacgggccaccatagtcacactggcactgaaaagaaagcgttgccctggtgattctttcccccccgtttgtaatgttaactgatcaggaagtgcagtttgggtgggatgccgaatcgtcgtgctgacattgagtcacggatgaggaaggtacaagtcctttaagatcaaaactcaaacgggccgttctttctaaggtgtcggtatgtggggagtggtacaaaatggtctgatgctccttcaaaaacattcactttttacaacgtcaaggaattaagcataaaaaagattggttaaaagctttggtttctagtaaaggttagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaactaaaaaaaaaaaaaaaaaaaaa

SEQ ID NO: 224 - DNA, 2722 bp, Homo sapiens
ttggcgcgtaaaagtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtttgggccgggttttgggactctgttgggaacatttcggggcgggagaggccaaggttgctggggaaatgcccattctccacttcccttctccctgtccgtgcccgatttgatttgagcctcataactcgaagaaaggtcagcttcctcgctgttttggtcctaactcaaaagcagatccagtaaaggtttttgttgtaaaaaaaaaaaaaaaaaaaaaaa

SEQ ID NO: 225 - DNA, 2006 bp, Homo sapiens
ctagcagcgggtcggagatcgaaggaacgggccaattgcggctgaaacgtctttggaaggaggaagggggtgagggagcatccctttgagtttcgcctcttctcgaggcggtggtgggaagggagacatacttaatactgccctcttaatccaacggaccttacatcgtgtagactgccgggagggcggcgggaaaagggcaagacgggagttggggaagggaaggagccaggaagccgcgcgggagggcgcgcgcgcgcgcccctttttcagcagtgtggcggggtcgcacgcacgcccgcctcggcggctgggcgcgatttgcgacagtggggggggcggtggaggtggcggcggcagcggcaactttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttgtaaaaaaaaaaaa

SEQ ID NO: 226 - DNA, 7102 bp, Homo sapiens
ttaggggcagaaaaacatttgtaataattaatggctttgagagacacaaggctttgtttgccccagagtattagttaacccacctagtgctcctaatcatacaatattaaggattgggagggacattcattgcctcactctctatttgtttcaccttctgtaaaattggtagaataatagtacccacttcatagcattgtatgatgattaaattggttaatatttttaaaatgcttagaacacagattgggcacataacagcaagcaccacatgtgtttataagataaattcctttgtgttgccttccgttaaagtttaaataagtaaataaataaataaatacttgcatgacattttgaagtctctctataacatctgagtaagtggcggctgcgacaatgctactggagttccagaatcgtgttggtgacaagattgttcaccagcatatggtgtggtgaaaactcactaatttggaattagttcagattattaagcctgaataggtgaaaatcctgaaatcaaggatctttggaactatttgaaatcagtattttatattttcctgttgtattcattaaagtgttgcaagtgttctatttgatggattaagtatatttaggatatacatgttcaatttgtgattttgtatacttaattggaacaagaaagctaataaaggttttgatatggacatctattcttttaagtaaacttcaatgaaaatatatgagtagagcatatagagatgtaaataatttgtggacacaccacagactgaaatagcaaatttaaaagaaattgttggaagaatcaagtgtttgtggaatgagtcctcctagtaaagttcctgctcttgtgaataattaagcctcatgtataattactatagcaaaaggaagcctaagaagtattagactctacttgtatttaaattacattttacataatttatgtgtatgaaaaatgttttaaatgcttattttcgtaagccatgagatagctcctttatattttaagaatttctgaattaatttgcttggattttattagtgcaaatggcagagctagcaattcctttttctgtgttcccattccatcctattcatccctcttttaggaaactctgaactctggattgtccttgtttacatacctgcctcctgcattggactatgtgtctctgagtgtagtatgactaattcatttgtttgtcaaggactctcaatgcatttgttgaacagcctaattagtaatgtctgcaacaatgacattttactgtatttaataaagctctgggaaagtaggatacacataagacaggtctaggtctaaattctttacagaaacttggatttttagttcggtttgaaatttgaagatgtgagtatatttatctcagtttcccaaaggacaagctaattggaattatcatcctctttcacttgattggatccccagaatgccatttacgcatgcagcaggattttataacagttttaaattctgtatatttgatgaagaggttttatatttttggattcaagcctctttttaaacttctacaatatggtttacaataattccttatatcctgcttttgaaatacatattacaactttttaagtttggaaggctatatttcaaggactgaagttacagtatactcaagtgatacacaagcctagcaccccactttccacatagtgttcgataaagattgataaactcgaaatcacagaccttttaattcttaagacaaatagcagcagaaagaaacatctttggcttatttctggtaaggtttttatgctctgtaaaacaaagaattgtattcatccgcgcagcacagattctattaaaaataaatgtgagagtcgttaatgtagtactgctcatttaccatcaaaattcacttttcaggaataatcccatcagtttaaattggatattggaatgagcattgattacatttaacttggtagcccaaaatttcttcatggggttttgaactcggcgggatttcaaaggttttaaaaatgagtttttgattttttttaaaaccctcaaatttcattacctttaaactaggtcgaaacggggcgcaagagattggattaacaccatagtaatacttattttgttcttaaccatttcagggcttcttgaaatagaggctgtatggtgtaatggaaaaaacagccttggaatctgggagcctgattcctggattcagtcccagttttgcgtgaccttgggcaagttactttacttctctgaatttccgtttcctcctctgcaaaatgaggatcgcaatagccaccttgcaaccttgactggagcgagcctcgcacaccccgcgccggcctggaggaagagcagccatgattacgccgccttcgctccgctacccgcttgcggctggcgccctcctccagcaggtgtaggcgctgccgcgctgccccacgcctttccgccgctcgcgggcctgcgcctcggcgtccccgaggaggccgctgcgggctgaggtagcgcaccggcctctcggcgtcccagtccggtcccgggcggagggaaagcgggcgacccacctccgaggcagaagccgaggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagccatggttgcttgttatccgggcaatggaacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttgaaacattaaaaaa

SEQ ID NO: 227 - DNA, 3928 bp, Homo sapiens
gtgtgagtcccatgtgcttggtgggaggcgctgtgtgagaatgtacagggcaggaggaaacatagcagggctggggtgcagaggaggcccagagcagtgcactccagtctgcaggtactgcactgggcactggggagaccaacctggccccaggggcttccctgtggctgccttccagggcagtactaggtaaacaggtgcctgtgctgatgccatgttgctaggagtggaacggacaatcagccggagtactcaaggtgacccttggtctctgaatcctgaataacaaagagggtcagaaggaagagtgtcccaggccagtgctgaggccttgtggtggcgatgagctcagcctgttgaggcatggagcagagtgatgggagaggcacatgaggttgggggcctttgaggctgtggttgggaatttgtattttctcaggatggagtgaagacctggagaggaggggctctggctgctgtgtggggatgaattgtgggaagagggtgcagcactggaccccttccctgccacccatccacgtgcatcatcagtgtaatctctgattggattcctaattggggaggtcttgcccatctctagtcagtaactcactgtttctaagcctcctggaccatggcccaattcttctcccagtgaggtggttgctcagagtgccgacccttccatagggagtgagcagtgcaaagaaggtgccccctcctgaaccttgaagtgtagccattagggttttccctggggggccttctcactaattgtactctggtgctgccagagagaaggttgtcagcttcccactgctaggtggcagtagatggtggcagccctctctttccagggcaaggtctggtggatgaggtgcacatggttaatgcagagcagcttaacatccaccacagagggtgagccctgggataatgtgttgggaggcgtcctggggagggtgaggattgaagcagcccagtctgctgtggcgtgcgtgcttggcaagcatcctgttgtggcagtggccactgatgtttgatcgtgaatgtttatcttgggactgtcttgctgggccgggcccataggtgtagctgagcattcgtggggaatggacgccagcagagttgtaccagggcagagaggtcagggcagagaggtcaagacagatggtccgggctggggagaagttgaagggtccttgtgccagtcctcccctttttgtgtgctacctcatcttgccactgcagtgactttgggcagagggtgggacagggaccttttaaaatttttaaatggcatttcagcctgtgctccagttctccatgtggcaggcactgtgctggctgtcttcccagacacttgttatcttgttcacttgttccacaacaacctgtgaaatagctgtgagctccattggatccatggatgaggaacctgagaccaggaagtcacctgcctgatgccacagctcatgtggcagcactgagacttgaaccagggaattgtgtctgcagaagtggctgggccatttcctttacctctcagccacctttctgccagctccctgatgacaaacatcccggggccctggccacagcattgtagggctgggtcaggggagtggcaactgtcaggcagaggaaagaaccctgtagacagagaaaccaagccctgcaatgagtcctgttagatctccaggagttggggctccagaacctcccaagttatgttctcagagagattaattgctaccgctgtaaacagcagtgtttattacccctgctgtacacatcaggcagttgaggcccattcaggtgttggaactggctagggttacccagcaaattatccttggagttggaattaggtctttctattcagactgtagcttttggctcctgttcggaggtctatgggacagataatttagtggggattctttgtagtccagggcagcagttcttaacattgctgcatggtagaattacctgggaagctttaccaatttcaggcccttccttaggccaggtacttcagaacctcagagctccccagggggctccactccacagccaagggtaagaattcctggtctagggctgtgaggccacctccttgcacacctgaaaatgtttaaattggtattattctactgaaatggctgaggtggggtttggggtatcttgaaacaaatcaaactctgttactaattgagccctagctgggtgccaggccccaggtatgtgtgttgggagggagtgggctcttgaggcccaggagctgaggtttctgatagacttggggatgggattttggctgaaaaagaaagtcttttggggcaggagcttggaacccttgacccaaggagtcatggggaagatggggcaaggaggggtgggaaaataggtaattcatggctgcttctctaagatgtgcctgcctagccccagtaaacctacctccctccatccctgccaggccatggtggcgtgttacccaggcaacgggctcgggtacgtaaggcacgttgacaatccccacggcgatgggcgctgcatcacctgtatctattacctgaatcagaactgggacgttaaggtaggggtgagggtgagggtgagggtggcgctggggctagggctggggcgggggtggcgtgcgtccactccattttccactctcagcccagattctggcattctcctgtttctcttctcaacacacagcgggcagtgcgatctgccggctcttcctgggaaatggcacctcctcctctctagcggactgtgtggtgggaactcccctctttccgggaatggtgctgtctgcccagccccacccggccttgtaatgaacactttcccccttttcctgtctttagtagcttcctgcccatctccatggtgatgcagtctctgggttgtcattcactttgagagcccgaggggtgggagggagtgatgcaggcagacgctgcgcctcctagtgggctcccggggcaccgtgggaggcagcggctcctggccgtaccagctagcctcatcctttggcctgcccccaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcaaaaaaaaaaaaaaaaaaaaaaaaaaaaaaaaaaa

SEQ ID NO: 228 - DNA, 3136 bp, Homo sapiens
gcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 229 - DNA, 2992 bp, Homo sapiens
aactgagcgaggagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggacccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattataaactcagagaacagaagtgcaatgtgatgggaggaacatagcaatatctgctccttttcgagttgtttgagaaatgtaggctattttttcagtgtatatccactcagattttgtgtatttttgatgtacactgttctctaaattctgaatctttgggaaaaaatgtaaagcatttatgatctcagaggttaacttatttaagggggatgtacatatattctctgaaactaggatgcatgcaattgtgttggaagtgtccttggtgccttgtgtgatgtagacaatgttacaaggtctgcatgtaaatgggttgccttattatggagaaaaaaatcactccctgagtttagtatggctgtatatttctgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagataatggatggtttgtgactatagtgtaaataaatacttttcaacaataaaaaaaaaaaaaaa

SEQ ID NO: 230 - DNA, 4342 bp, Homo sapiens
gatcaatactgaggccgcgtccgacccccttgagccgagatccccccccagcccagcccccaccccaccccccgcacacgccccaccccccccacgacccagcctcataccgcaccagctgaggcacccaagaggattaccccctggggccctctcccgccccccaaaaaagagaagatcccctctcctggcccatcccttcccttcttccctcccccctccccccgaactttccctctcgcatgcttttcccctgcaccacggatcgcctctcggatgccgcttgcctggaagctgcgttaggagcgagcggcggcggtggcggcggtggcggcggcggcggcagctcgggagtgctatgaccggcaaactcgccgagaagctgccggtgaccatgagcagtttgctaaaccaactgcctgacaatctgtaccccgaggagatccccagcgcgctcaacctcttctccggcagcagcgactcggtagtccattacaatcagatggctacagagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaaggagcgcaccaaagcgcagagcttgctgcccgccgcacgcacgcgcgcctgcgtgcggggatgcgcgcgagtgtgtgcgtgctcgcgtgtgtgtgtatgtgtgtgtgtgagtgtgtgtgtgtgcgcgcgcgcaagcgtgtgtgtttaagactcttgagctgaactgggctgtgtttaccccaaactcttccccacctcgggtccccaagccgctgggagatgtcccatgctgggggtccgcacgtggctggaggaggtggtcttccatccgctctgaaatcatgtttcttagagaaatgcctcggatgccgccgacgcggtgctgctgccgccgcttcgggtttggcccctcagaacccctccttttctgagcgcttccctcttaggcctcagggcagtttgatctgtggggagaaagagcagccatcgctgagcctgccttttaaaatatatgtgtatttccttagccccactctaagaaatctatgttcctgagtttgccccctgccctcccactccttccccttctcccctctaaaccttctcccatctctttcaaaatcttttcccagaaaggcaggcttcaaccagccactccagctttgtgtcttctctcaattacatagcaatttctccttcccaccatcatggggaagctggctctgcttttgccctttgtcatcaccaacacaacagatagaatttaaatataagtatatggtgtgcgtgtgtatgtatgtgtatgtatatgcatgcatgtgtataaagatgcacatgcgtacatatacataacatacacacaatatgtattcctagcaaaataaaatctctaaggtacttggttatccagtgcagtgcaccggaataaagagaatttgtaggcgtatacagctttaaatgatttattttttatgaaaatgttaactgatgagattatatctacatacgtgtgttatgtgtgtggatatagatgcacacatatctgtacatatacatgtgagtgtacatatatacacatatacacatctatgtatggatatgtgtgtatacacatatacacatctctgtccaaaatttcctcaaagatatggggattttttcatgaatccatgtggatgaatgaggtgtctcctttccatacccagtctcaccttctccccaccctacctcacctcttctcaggcacccctcttccccagctgtcctgccagcccttctcgtacagggtggctcctttgaagtggagtaatagggaaggttgctctctgccacagcttgcagcatggtcttgactgaatgtactgttcctgttagcgttacttctcctgtggtcagtaagttgcccagagagaaggaacaaaggtctggagtttacagaatgtctgtttttaaagtcactttatgcgttttccacttttttcttttttaagaaaaagaagtaccatttttgttttgttttgttttgatttttggtggtggataaataatactaaaaggactctagtggaaaggggggatatcgaagagcagggggttgtgaatttccaggtacttggactttttgtagaaggagagagaagaagatgaagtttgccaggagggcccatattttttcagctgaagggtaaaatctttctttgcagagacagtattttgctgaatactttttataatgtgatgattattaaaaaagcaaaaattttggtcacttccaagctagaaggaggaatcagataccctttaatattttttcctcgctccttctggtatatgcatgtcactgcatgataattgagttttcctttgttttaataaaactgttctcagacattaagctaaactaagagaaaaataactttgttgccaaaaggttgtgctatccagattttttatatgtctgcatgtttaaaaaaaaaaagcaacaaaagaaaatgcactctaacttatgtgaactgagagaaaaaaatcaggttttaaacaggaaaacctatggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatcagccggcctataaatctccttattttatttcttgtttttatagcataaagctttagtttggcctgaaaaaaaa

SEQ ID NO: 231 - DNA, 2379 bp, Homo sapiens
cgggagtccccggcacacatcctgtgtccatgtttgggcatttacgtcacggcggcagggccggggcctcccaaaatggcagtggcccggggagtcggaagcccggagccagcgccgccgcagctatataagtgggggggctgtgggctgggggagcccggcagcgctttggagaggcgaggagccgccgcccgaggccggtgcgggcgagcgagggcgccgcggctccccgactcctttcccagaggtgagtgcccgaagccaggagcccgggcgcctaggtctgtgcgctgcggggaacccctaccgccagcctccccgccacccgcgcgcccccaagcccagcgggcgaggccccgggcgccccacagccggcgccgcgccatgctccaccttagcgagttttccgaacccgacgcgctcctcgtcaagtccactgaaggctgttgcgccgaacccagcgctgaattgccccggctgcctgccagggacgctcccgcggccaccggctaccctggagcaggcgacttcttgagctgggctttgaacagctgcggcgcaagtggggacttagccgactcctgcttcctggaggggcctgcgcccacaccccctcccggcctcagctacagcggtagcttcttcattcaggcagtgcccgaacacccgcacgacccggaggcactcttcaacctcatgtcgggcatcttaggcctggcacccttccccggtccagaggcagcagcgtccagatccccgctggatgccccttttcctgcggggtccgatgccttgctgccgggtccgccggacctttactccccggatctgggcgctgcccctttcccagaggcgttctgggaggcctcgccttgcgcgggtgccccctcgcagtgcctgtatgagcctcagctctccccgcccgacgtcaagcccggcctccgggcgcctcccgcctcgccagcgctggacgctgtctctgccttcaagggtccctacgcgccctgggagctgctttctgtgggggccccagggaactgtgggtcacagggagactaccaggccgccccggaggctcgttttcccgtaatagggaccaagattgaggacttgctgtccatcagctgccctgcggaactgccggccgtcccagccaacagactctatcccagcggggcctatgacgctttcccgctggccccgggtgacttaggggagggggctgagggcctccctgggctcctgacccctcctagtggggagggagggagtagcggcgacggcggagagtttctggccagtacgcagcctcagctttccccgctgggccttcgcagcgccgccgcggcggacttccctaaacctctggtggcggacatccctggaagcagtggcgtggctgcaccacccgtgccgccgccgccgcccacccctttcccccaggccaaggcgcgacgcaaggggcgccgcggcggcaaatgcagcacgcgctgcttctgcccgcggccgcacgccaaggccttcgcttgcccggtggagagttgtgtgcggagctttgcgcgctccgacgagctcaatcgccacctgcgcatccacacgggccacaaacccttccagtgccgcatctgcctccgcaacttcagccgcagcgaccacctcaccacgcacgtgcgcacccacaccggcgagaagccttttgcttgcgacgtgtgcggccgccgcttcgcgcgcagcgatgagaagaaacggcacagcaaggtgcacctcaagcagaaggcgcgcgccgaggagcggctcaagggcctcggcttttactcgctgggcctctccttcgcttctctctgagcaagagatgggtttatgggttggggcgccgccgttcggcgcgcacgagttccgggccgttcccctccccgctcttcttccaactcctcctcgcacgcccgagggccggcctccggtcccgcttccagtttccttgaagcgcccgccgcacacgccctattcagcaccagctccgcggacagttcccgcggtccaggcgctgtcacccttgtcagccgcgctttgggggaagtcttctgagaccacccagtgaataggcactaccctgggattcaagacagtcttttgtaactggcacacgccccacgccttcctctataacccccagagacaggctggggcagcgccaaggcggtctcgcgcgggactttgtacagcagtgtcttatccagcagccattggatgtaacgttttgctttgggttttttttccttttgttgttgttaatttttgtaaagcagacgctactctcaagcagttgacaaaactgtttatttttgcaattaaaattattgtgctaaaagcttaaaaaaa

SEQ ID NO: 232 - DNA, 3617 bp, Homo sapiens
acccgtggtgccccatccctataggagctggtgagattgcagcctgctgcctcccctccatcagccacagctattggatttcccacccagaatctttaggtaaatgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacctctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataacgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttctt

SEQ ID NO: 233 - DNA, 4985 bp, Homo sapiens
agtccgggtcttggcgggccccctcctccctcccgctccccgcgctctcgccttttaatcatgcccctctgtctgtgtgtgagtgcaggcaggctgacaatgatttcctcagtgattacgtacagagcgagtccctgcgggttaggggccccctctggagccatcctgatggctttgggggccttgcttccattttccattattatgtggactaccggagcgacagcgcagtccaagaccttgcaggatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccctattcaggcaagattaaaaaaaaaaaaagactatgaccaaaatggcttaagataaagtatttttaaggaagaaagattaaaaacaactgttatacatgagactatggttggacttccttttctttacacttaagcctagaatttctctttaggtatatcagcgcttaaatccaagactattttttattgctgaagattcttgcaaaccatgaagagatgttctcacagaacagaaccccacagctggataaggcccgtatatatatatttgtaagccttgcaatgtgacaggtagcatcactatatatgcaatagttgttatgtagactgtcaaagaatttttttttccctggatacatttgaagctttgagtgttcaaggttttccttaatgatttcacgcagccaaattcttgaatcagttgaactaacctgtatgttactgttattaatgtttactctgcagtctgaacctggagattactggaattgttttccaagaggaaataaattcagtttaccattaggaaaaaaaaaaaaaa

SEQ ID NO: 234 - DNA, 8126 bp, Homo sapiens
cggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggccatggagacggggctgctccccaaccacaaactgaaaaccgttggcgaagcccccgccgcgccgccccaccagcagcaccaccaccaccaccatgcccaccaccaccaccaccatgcccaccacctccaccaccaccacgcactacagcagcagctaaaccagttccagcagcagcagcagcagcagcaacagcagcagcagcagcagcagcaacagcaacatcccatttccaacaacaacagcttgggcggcgcgggcggcggcgcgcctcagcccggccccgacatggagcagccgcaacatggaggcgccaaggacagtgctgcgggcggccaggccgaccccccgggcccgccgctgctgagcaagccgggcgacgaggacgacgcgccgcccaagatgggggagccggcgggcggccgctacgagcacccgggcttgggcgccctgggcacgcagcagccgccggtcgccgtgcccgggggcggcggcggcccggcggccgtcccggagtttaataattactatggcagcgctgcccctgcgagcggcggccccggcggccgcgctgggccttgctttgatcaacatggcggacaacaaagccccgggatggggatgatgcactccgcctccgccgccgccgccggggcccccggcagcatggaccccctgcagaactcccacgaagggtaccccaacagccagtgcaaccattatccgggctacagccggcccggcgcgggcggcggcggcggcggcggcggcggaggaggaggaggcagcggaggaggaggaggaggaggaggagcaggagcaggaggagcaggagcgggagctgtggcggcggcggccgcggcggcggcggcagcagcaggaggcggcggcggcggcggctatgggggctcgtccgcggggtacggggtgctgagctccccccggcagcagggcggcggcatgatgatgggccccgggggcggcggggccgcgagcctcagcaaggcggccgccggctcggcggcggggggcttccagcgcttcgccggccagaaccagcacccgtcgggggccaccccgaccctcaatcagctgctcacctcgcccagccccatgatgcggagctacggcggcagctaccccgagtacagcagccccagcgcgccgccgccgccgccgtcgcagccccagtcccaggcggcggcggcgggggcggcggcgggcggccagcaggcggccgcgggcatgggcttgggcaaggacatgggcgcccagtacgccgctgccagcccggcctgggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcaggactctggagatgccacatggaaagaaacattctggttgatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaagaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctgctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcatttttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatcttgttaagcactgtgaaaaaaaaaaaaaaaaaaaaaa

SEQ ID NO: 235 - DNA, 3564 bp, Homo sapiens
tctacaggagccattttaacagctaaaacttgtcggattgctttttattttcaagctcaaaagacgatagagaaagaatacttgaaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccaatgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcactatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaatttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggattagactagatgatcaccactttctcttctagttctaatttttttaattctaatacctatattttcaagttatgtcaattaaatcattatcaggttatttcctaatgtaagatagctaaaatgttgcagagaaataagtgacccaacaaaatttattcatctgttatgggtcaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttgggggggttgcatatcaaagataacatatatatccaactttctgaaatgaaatgtttttagattacttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaa

SEQ ID NO: 236 - DNA, 3171 bp, Homo sapiens
gttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttgg

SEQ ID NO: 237 - DNA, 3149 bp, Homo sapiens
ctgagctcagggaggagctccctccaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaaacaaaacaaaatggagatgagtacttgctgagaaagaatgagggaaggagttggcatttgttgaaagtgtagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaaaaaaaaaaaaaaaaa

SEQ ID NO: 238 - DNA, 4195 bp, Homo sapiens
tccacttctcctttcgccggcgccgagttcctggcgccgctcgcccggcccggcttccgaggggagaggacgggctggcggggctggggacccgcgtctcggcccccggagcggggaccacggagacagaccccggcccggcgaccgagctgggcccgtgagccactcggcctcaggtcgctcctgtggttggtccagcccagaatgcagccttgagcctggcttaggccaccacctactccagctctctccaccccctattttactgcagctcagggggtaggctctaggctccaaagtacctgggtattgtcccttcatcaagaaagccccacagctctggagggctctgataatcccgttgtcagctctctgaaaagacagcatggctattaccctacagcccagtgacctgatctttgagttcgcaagcaacgggatggatgatgatatccaccagctggaagacccctctgtgttcccagctgtgatcgtggagcaggtaccctaccctgatttactgcatctgtactcgggactggagttggacgacgttcacaatggcatcataacagacgggaccttgtgcatgacgcaggatcagatcctggaaggcagttttttgctgacagatgacaatgaggccacctcgcacaccatgtcaaccgcggaagtcttactcaatatggagtctcccagcgatatcctggatgagaagcagatcttcagtacctccgaaatgcttccagactcggaccctgcaccagctgtcactctgcccaactacctgtttcctgcctctgagcccgatgccctgaacagggcgggtgacactagtgaccaggaggggcattctctggaggagaaggcctccagagaggaaagtgccaagaagactgggaaatcaaagaagagaatccggaagaccaagggcaaccgaagtacctcacctgtcactgaccccagcatccccattaggaagaaatcaaaggatggcaaaggcagcaccatctatctgtgggagttcctcctggctcttctgcaagacagaaacacctgtcccaagtacatcaagtggacccagcgagagaaaggcatcttcaaactggtggactccaaagctgtgtccaagctgtgggggaagcagaaaaacaagcctgacatgaactatgagacaatggggcgggcactaagatactactaccaaagaggcatactggccaaagtggaagggcagaggctggtgtaccagtttaaggagatgcccaaggacctggtggtcattgaagatgaggatgagagcagcgaagccacagcagccccacctcaggcctccacggcctctgtggcctctgccagtaccacccggcgaaccagctccagggtctcatccagatctgccccccagggcaagggcagctcttcttgggagaagccaaaaattcagcatgtcggtctccagccatctgcgagtctggaattgggaccgtcgctagacgaggagatccccactacctccaccatgctcgtctctccagcagagggccaggtcaagctcaccaaagctgtgagtgcatcttcagtgcccagcaacatccacctaggagtggcccccgtggggtcgggctcggccctgaccctgcagacgatcccactgaccacggtgctgaccaatgggcctcctgccagtactactgctcccactcagctcgttctccagagtgttccagcggcctctactttcaaggacaccttcactttgcaggcctctttccccctgaacgccagtttccaagacagccaggtggcagccccaggggctccactgattctcagtggcctcccccaacttctggctggggccaaccgtccgaccaacccggcgccacccacggtcacaggggctggaccagcagggcccagctctcagccccctgggactgtcattgctgccttcatcaggacttctggcactacagcagcccctagggtcaaggaggggccactgaggtcctcctcctatgttcagggtatggtgacgggggcccccatggaggggctgctggttcctgaagagaccctgagggagctcctgagagatcaggctcatcttcagccacttccaacccaggtggtttccaggggttcccacaatccgagccttctgggcaaccagactttgtctcctcccagccgccccactgttgggctgaccccagtggctgaacttgagctctcctcaggctcagggtccctgctgatggctgagcctagtgtgaccacatctgggagccttctgacaagatcccccaccccagcccctttctccccattcaaccctacttccctcattaagatggagccccatgacatataagcaaaggggtcagggcaagtgtgacccaccaggcaaaattgagcagcattttcatagggaccgacttcagtagcacacctgcccctgcatttcagtgggatgtcaatacacttgaccccaagtcccccggccctgcctggtgtcactgtggccaaacagtgcccagcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctagggcttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacacctaaccctgactccttcaccaagaagacgggagtcggcagccaggagttcccgtggcacctctctctcttcgtggctccctgcttcccccttccctctttccgaggaagggtcaacctattctctctcaaagccaacccctaggccaattgcctggatctcctcccctctcccttctttaaacgagcttgcctccctcctgccaagtttgagggcaaggctaagaaatgtcagccacggaaacaactctattatctggtgactttgggtaatgtgaatcagtgcctgaggacctttgctgtgtccttggtacagaaccatccacttgacctaactacctcccctggccgcgctctcgctcttctcttctttgttaagccaacaactatcaccctctcctactcttcttctccctgccccctggagggcactgtgtttggttgtgcaaatgtatttactatgcgtgtttccagcagttggcattaaagtgcctttttctaataaaatcagtttattatgacagtttcctgaaaaaaaaaaaaaaaaaa

SEQ ID NO: 239 - DNA, 2317 bp, Homo sapiens
cacaaggctacaggtgtctttatttccactgcacgctggtgctgggagcgcctgccttctcttgccttgaaagcctcctctttggacctagccaccgctgccctcacggtaatgttggactcggtgacacacagcaccttcctgcctaatgcatccttctgcgatcccctgatgtcgtggactgatctgttcagcaatgaagagtactaccctgcctttgagcatcagacagcctgtgactcatactggacatcagtccaccctgaatactggactaagcgccatgtgtgggagtggctccagttctgctgcgaccagtacaagttggacaccaattgcatctccttctgcaacttcaacatcagtggcctgcagctgtgcagcatgacacaggaggagttcgtcgaggcagctggcctctgcggcgagtacctgtacttcatcctccagaacatccgcacacaaggttactccttttttaatgacgctgaagaaagcaaggccaccatcaaagactatgctgattccaactgcttgaaaacaagtggcatcaaaagtcaagactgtcacagtcatagtagaacaagcctccaaagttctcatctatgggaatttgtacgagacctgcttctatctcctgaagaaaactgtggcattctggaatgggaagatagggaacaaggaatttttcgggtggttaaatcggaagccctggcaaagatgtggggacaaaggaagaaaaatgacagaatgacatatgaaaagttgagcagagccctgagatactactataaaacaggaattttggagcgggttgaccgaaggttagtgtacaaatttggaaaaaatgcacacgggtggcaggaagacaagctatgatctgctccaggcatcaagctcattttatggatttctgtcttttaaaacaatcagattgcaatagacattcgaaaggcttcattttcttctctttttttttaacctgcaaacatgctgataaaatttctccacatctcagcttacatttggattcagagttgttgtctacggagggtgagagcagaaactcttaagaaatcctttcttctccctaaggggatgaggggatgatcttttgtggtgtcttgatcaaactttattttcctagagttgtggaatgacaacagcccatgccattgatgctgatcagagaaaaactattcaattctgccattagagacacatccaatgctcccatcccaaaggttcaaaagttttcaaataactgtggcagctcaccaaaggtgggggaaagcatgattagtttgcaggttatggtaggagagggtgagatataagacatacatactttagattttaaattattaaagtcaaaaatccatagaaaagtatccctttttttttttttgagacgggttctcactatgttgcccagggctggtcttgaactcctatgctcaagtgatcctcccacctcggcctcccaaagtactgtgattacaagcgtgagccacggcacctgggcagaaaagtatcttaattaatgaaagagctaagccatcaagctgggacttaattggatttaacataggttcacagaaagtttcctaaccagagcatctttttgaccactcagcaaaacttccacagacatccttctggacttaaacacttaacattaaccacattattaattgttgctgagtttattcccccttctaactgatggctggcatctgatatgcagagttagtcaacagacactggcatcaattacaaaatcactgctgtttctgtgattcaagctgtcaacacaataaaatcgaaattcattgattccatctctggtccagatgttaaacgtttataaaaccggaaatgtcctaacaactctgtaatggcaaattaaattgtgtgtcttttttgttttgtctttctacctgatgtgtattcaagcgctataacacgtatttccttgacaaaaatagtgacagtgaattcacactaataaatgttcataggttaaagtctgcactgacattttctcatcaatcactggtatgtaagttatcagtgactgacagctaggtggactgcccctaggacttctgtttcaccagagcaggaatcaagtggtgaggcactgaatcgctgtacaggctgaagacctccttattagagttgaacttcaaagtaacttgttttaaaaaatgtgaattactgtaaaataatctattttggattcatgtgttttccaggtggatatagtttgtaaacaatgtgaataaagtatttaacatgtaaaaaaaaaaaaaaa

SEQ ID NO: 240 - DNA, 2833 bp, Homo sapiens
ctcgggcccacgtgagctgtagggaaacgcaggggcggcttctaggtgctgccgccgccaccgccaccaccacctccaccgccgcctcggaacccaggcctggggggcggtggggccgcgtatggagcccccgccccccggagctgccaacattgccaacgccaccgccacgctacacacaggtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgaggtcgcagggtgctccactgaggactgcccgccccagccagaggtgtctgttacctccaccatgccaaatgtggcccctgctgctatacatgccgccccaggggacactgtctctggaaagccaggcacacccaagggtgcaggaatggcaggcccaggcggtttggcacgcagcagccggaacgagtacatgcgctcgggcctctattccaccttcaccatccagtctctgcagccgcagccaccccctcatcctcggcctgctgtggtgctccccagtgcagctcctgcaggggcagcagcgcccccctcggggagcaggagcaccagtccaagccccttggaggcctgtctggaggctgaagaggccggcttgcctctgcaggtcatcctgaccccgcccgaggccccaaacctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctaggtgggccgggacccgaacggaccccaggatcgggaagtggctccggcctccaggctccggggccggcgctgaccccatccctgcttcctacgcatacattgaccccggtgctgctgacacccagctcgctgcctcctagcattcacttctggagcaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgccgcctcccccactccaagtgtttatttttgataccaaacatgaattttcagttccctccctcccagccccccaatttcctgcgggcgggtacaaaggaccctttcaatgtccctggagttgggagggaggaatgggggacataaagcctgtcctgtctctattctaggcaagagagagtgggttcaaaagactcctgggctcacctgttagcgctggcccagcccaggccttgggacctgggggttggtgatttgggggacagtgctacactcgtctccactgtttgttttacttccccaaaatggaccttttttttttctaaagagtcccagagaatggggaattgttcctgtaaatatatatttttcaaagtgaaaaaaaaaaaaaaaaaaaaaaa

SEQ ID NO: 241 - DNA, 2180 bp, Homo sapiens
gggcggaaaagcctgtttacacagactgcacaccgcctggggaataatgcagtaaaggaagtgagccggctcggcctgactgctccaacttcctgctctcacacacaccagaggggaaaaaaaaagaggagcgagagaaagaaaaaaagggggaaaaatcaggatctcattacaagagccacagaccgtctgcagacgcctgtcagcatggaaagtcgggggctttcgcccgggtcctcctagaaattccccccgaagaagactcccccacatctgggtatggagagtgcaatcacgctgtggcagttcctgttgcagttgctgctggatcagaaacatgagcatttgatctgctggacctcgaacgatggtgaattcaagctcctcaaagcagaagaagtggccaagctgtggggactccgaaaaaacaaaacaaatatgaactatgataagctgagcagagccctgcgatactattatgacaagaacatcatcaagaaggtgatcgggcagaagtttgtgtacaagtttgtctctttcccggagatcctgaagatggatcctcacgcggtggagatcagccgggagagccttctgctgcaggacagcgactgcaaggcgtctccggagggccgcgaggcccacaaacacggcctggccgccctcagaagcacgagccgcaacgaatacatccactcaggcctgtactcgtccttcaccattaattccctgcagaacccaccagacgccttcaaggccatcaagacggagaagctggaggagccgcccgaagacagcccccccgtggaagaagtcaggactgtgatcaggtttgtgaccaataaaaccgacaagcacgtcaccaggccggtggtgtccctgccttccacgtcagaggctgcggcggcgtccgccttcctggcctcgtccgtctcggccaagatctcctctttaatgttgccaaacgctgccagtatttcatccgcctcacccttctcatctcggtccccgtccctgtcccccaactcacccctcccttctgaacacagaagcctcttcctggaggccgcctgccatgactccgattccctggagcccttgaacctgtcatcgggctccaagaccaagtctccatctcttcccccaaaggccaaaaaacccaaaggcttggaaatctcagcgcccccgctggtgctctccggcaccgacatcggctccatcgccctcaacagcccagccctcccctcgggatccctcaccccagccttcttcaccgcacagacaccaaatggattgcttctgactccgagtccactgctctccagcatacatttctggagcagccttagtccagttgctccgctgagtcctgccaggctgcaagggccaagcacgctgttccagttccccacactgcttaatggccacatgccagtgccaatccccagtctggacagagctgcttctccagtactgctttcttcaaactctcagaaatcctgatgacgtctggccacaattaaggactcattaactgatgaaacaaatttgtccccacgggctagtttacctgtgtcgtgagaaggacattgtgaaactcttgttaatttggtttgcacttttcataacatggatagtctagatttatgttagcattttaaaaactgtttttgatatattcaagtatatatgaaaatctgtttggcattaagtgaattttaatgtttttgtttttatatccttttagctcttaagtgttgaacactgttgacagtgaagaacttttcttaatggttttcagtataactaataaggatgtgaagcttttttctctttagttctgagtatgctaaactgtgtgcttatatagactataaccagttgtgccttcctttgcatttaatgtaaatgaatgatttatatattttttagtattaagaggaaatgtttgaaagatgaaaattagtatcaaacagctctctagtagaatttcattatttttcaccagtgggcaatatgaaagcatatatcacgttttgttttactttcaattgtataagaattgccttagaacctcttttgaactgaaattcagtaaatgtccaagtaatgtttttataataaactaagccatatttagacaataaacatcgaaaaaaaaaaaaaaaaaaaaaaaaaaa

SEQ ID NO: 242 - DNA, 3077 bp, Homo sapiens
tttcttgttaaacaaacacctaatttatttcttggaggttttgttcagctgtcctaatttatgactttacattccttctggtgctaaactgctcaagtagcctcttgtatcaagtgtgacctgattccttaagaattttacttaatgagaacctctaagctagaaactcttgctaggtgtttcatgcaccttattttctttaatcattacaacaactctaagattgggttctctccaccttataaatgatgactgttttagagaggttaaggttgcttaaaattggtgagttagtgaggggtagagccacgaatggatttctggtcgctgcctccatcgtcagggcaagcttttcccacgactccagcgcttccatttgtcagtccccaggctagaaagccacagtgctaatttagtatttatcaagcgtttgtagtgtcctgggatctggcacttcgatgagaaagctgtgacggccccaacttctaacagcgagtggtaaggaggacgagggacacaggagggaggagactctccccaaagcttagcaccaacagaagtggtcccccgcaggttgctctgcgagcgccacctcttccctccaaccgaggagaaagtggcgcgcctttgaggagtccgaggtcccggcccaggcggcagcttgggtcctggcgggttccggacgggcgcctcagggacctggaagcaaccgcaccgaacgcgacggagagcggcgagacgactccaggaggcgcccgagctacatcccccggccacaccaaacccgggtttgctggcagacgcggctcacgacaccccttagggtcgcagcccctcccccggaagtgacgtgtagcgactacggcgtctgggagggacccaggagcagtcggggggtttgagagtggcggcggccgcggagggcctggcaggccccgccgctgcaaggaacgccccgaacgcgcgcgcccggcgtgtagcggccccaagacccgcgccgccgctgccgcgtgcgggggcggggagggcggggcgccaggagccgcggcggcgggagatgcgggcggctgcgggcacccggcgggctcggcttggccgccgccgccttctacggctccgccgcgggggtcgcagcggctgccgcgccgtcctcgagtttccagcgtgaggaggaggctgagggcggagaggcgcatcgtgttcgaggcggagaccgagggggagccccgcgcgcggcgtcgctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacaggtagcttgctcgctctttatggtgtcaccattgctttcatttatttgcccttttaagcaaatccagaatttatacactcaagtttgctttctgttacttaggtttgtcttagaaaggttatgtgtgactgtcatgtgaaagttaccccatttctcatcttaattaggattgctaaaatagaaagtttggagtattttcttaaaaaattcattgttctacaagtaaataaatattttgatttttctatttcctcctaaagaaagtacacacactctctcgctctctctcggtcttataaaactcgttggtgtcttataaaacaaacagtgataatctcaagttagaaaacagtaggtcctgagaaccataagaaaaatgactggtgtgatgttgagtaacaagttggtacagttactttagctatttattaacttgctcatctcatagaacattttagtagatttttcacacacctcattattaaaaaaaaacaaacatgctggtgtcttggttacccattattcctctgtacctgaattcaggttggtttttctatttggaaaagactttataaatgttggcttaaaaagaggttgagcaccagaatctcagaatttaccaccaaagaactcatccatgtaaccaaaaaccacttgtacccccaaaaactattgaaataaaaatttaaaaaattttaaaaaaaaaaaaaaaaaaaaaaaaaaaaaaaaaaaaaaaaaaaaaaaaaaa

SEQ ID NO: 243 - DNA, 5616 bp, Homo sapiens
ctcagactccgacgctgaggactccgccggctcggaggccgccgcgagagcccgggacccagcgggtgagcgcagggcggctgccgaggcgttgcggctgctgcggccggagcaggtcctgaagcgcctcgcggtgtgcgtggacacagccatcctggaagacgccggtgccgacgtcctgatggaggccctggaggccctgggctgcgagtgccgcatcgagccccagcgcccggcccgcagcctgcggtggacccgagcgagtcccgacccctgcccccgcagcctgcctcctgaagtgtgggctgcaggtgaacaggaattgctgctgctgctggagcccgaggagtttctgcagggcgtcgccacactgacccagatctctggcccaacccactgggtgccctggatctcccccgagaccaccgcccggccccacctggctgtcatcgggctggatgcctacctgtggtaccgctcactctcatgcccacagcagggctggctgggacgggggttcaggggaggtgggcacacttctggggttgctgtggcacagctgatcccacttctccaggtgggctctggcagaggccaagctcgggcagggcaggccccatggggagcggggaggaatggtcacctctgctcaggtctcgccagcacgtttcccgggggacacagcagccagagagcccgaaggtggccggtgccgaggtggccgtcagctggccggaggtggaagaggccctggtactcctgcagctctgggcaaacctggacgtgctactggtggcctcttggcaggagctgagtcggcacgtgtgcgccgttaccaaggctctcgcccagtatcccctcaagcagtaccgggaatcccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggcgctggaggcctgcagcacggagcgggagcgcatgggcctcctggccgaccttcctgtgccgcccagtgaaggcgggcgtccccgcagggtggggcctgacctctcccgccgcatctgcctcttcctgaccacagccaaccctgatctcctgctggacctgggctcctgaccacacgtgggaccaccaggacagcatgcagccttggggacagaccagacaccctgggcggtgggggaggacccccagccacatgtggaccctcagcctgggtgggttctctggctgagcaggtctgacctcagggggagggtgggtggttgcaggggaagttttaggtagctgggaggagaagaggggcttctggctggcagatggctggcggttcctgtgctgagtcctgaacacgtaggccccaggggaggcctcagcagcagggctgtgcccccccaacacacacacacactcggcagggaccagaaggcagctccagggccccactgccacctggaggcttggggtgtggcaccctcagccagaagcagtaggggactcccaaggatgtggaggggcagtgaggcctgggagaaggcccaggctgctcgcaagcccggcctctgcacggatacgtttcagctcacgccatgtgggtgttagacatcaactctacatttattgcagtcctttaagtctatgacggcggggcagccgctgacagcatgcagagcaagttaggaaaaaccgaggccctgtgggaacagcaacgcgggctccagccaggctctcgtcctcgcagcctcccacaagacctggggctcagggcagccgcttccccacccagcacagcagcagaggggccctagagcccccacagaaaggactgtcccagcctcgggagcaagagatggctccctccggacgggcctcatccaactccgccctggagtgtggctggaaggaagggacagagaaagaagggacagaggaaaggggctgtcccagcccaagaaggcagttccactgggaagtcagtcaggtccggcggcagcgcttcctctggcagggccgaggctcgcgactgctggggtgggcggaggtcgctgcctggggatcggacactggagccttgcggcggctgcaactcatgctcaggacccagcccagcttgttgtgtagcacctgcttgaggcccggcggcagcggcagaccctccagcgtgtctcccgagtctggccgcagctggcgcaggcggtggcagcacaggtactggagggaagtggcgctggcacaggagcgggtgaccttcatgctgctccgggccgccgtggagcacaccatcgggtagaatctcttgttctgcagcttggtggctgccacacctggaagggaggggcccagcctgaaccccaggcagggaaggggccagctactgggcgcagcccctcagacctcacgctacagtcacccgggtgggcagctggcacagctgaggcaaggcagggtgcacgcgctggccctgccactccagcctggcctcactgtcccaccccctgggaccctggggcctcaggcttctgggaggaaccctttcagaaaacctcagtgtcccctgggctggggcggggtggctgcctccctcggggtgacagctgagaggagctcaagtcctgtgacggcctcacctatacacttcctgttcttgaaaaaggtgagtgtgccgtgccaggtgtccaggtgcacgccaatgatggagccctggccgaaccgcgatgagaagctggtcttgtcgcccttgtggtggaggaggcctgggggcagccagggtcgcagtgagcccgggagctccaggctcggccccgccccaccctgggcctcacgcacccgtgtaggagaggccccagctgtcctcatccctgcccagcaggctgcagaacgtgtggcggtatttgtccaggtccacatccgacgtcccgatgcccaccatctaggaacaggggccaggcagagggcgcggggctgggctgccggagccaggttccccagaagcaccctgggccgaagcaacttaccatgtcggtgccgtagacgggagaggtcatcttgatctcccagaagtgctggccctcccccagctccttggtgccccggatggccgctgtgccgcagctgtactccatgtggaagctgaccttacggttgtcacagctcagcagggtggctgatgacttatttaagtcatcccagacccagtcgaaatctgcaagagaggcccaggctggggcagccctgagagctccatggggctctgccctgcccacccccaggcccgcccgcagtgcagtcccagcaggggctgggccccacgctcacactcgtcttcctctccgcagcggcagtccctgccccggtgggccgagtgcaggctgctacagaaggaggcctcgctctgcccagcacagtcacagaaggactcgccggtcacgggcaccgcactggggatggatggcggcagcgtggagtactcggggtcggagtccgagtcgctgtgctgggagagaagggccggctgttactacctgttgcccgctctctaccctctcacccttgccctctgtccctgtcccaccctgtccctgacccacccaggaaaggatgggggtccaggcctccagggacttcacagtaccccgagcgcacagcccaggctccctcccaacgggctccggctctgccccattctgcatgaccaggagggccctggaggcccagccacagagcagtagccaaggctgcctggcctccaagtggtttctagacggtggataagccccaggtccaccccacctgcccagagctgagatggtgtggacaccttccctgctaggccagccctgcaggggcccccaggcaaggccaccacccccacaccaggcccagctgcagccacccggcctcagggcagtccccaccacactgtggcccaacgaccttcctgttacctgagcagacctggctcaccacagggtcctactgcccagtgcccactacaggccccgcccctcctggtgcaggtttcagctgtcacctccctgaggcttctccagccccttcacccctgttccatttttcttcttttgcttcactgaagttctccttggtcctgattcttggcctcctcccaccagaacgtgagctccttgtgggaggcagtgcccctcccagcctcctccctgtcacagactgtgtgggggccacccaggggctgaatggaccagggggtcagcagggagagtgctaagtggtggcggggggcctgtggcagaggccttgtgacagtgagggttgagggctggtccagagagatgatgtgatccccaggagaagccacaggggaccatgacatgggcgccaccagcttccaggtgaacgtggacctatcgaaagccagcttcagggcaggacactgtcctttctggaggggatggccccaccccacagacaaggcaggcccagacaactctaccccactgcctagaagtgcgggtccccagagccagggtagaccccctgagtcaggagcccgggcacagaactgagcacctgcactgcaggcccagggccgggttccctggagaaggagaaagactgaagccactgcctacctcctgcccacaacagactgcaggcccatttggtgacacaggacaagcagcacatgtgtcgaacactgccgagcccgcaggcacgcctgcatcccacagccacgagcctgtgaggctcaggcatgtgacctgcaggagctggaggcgggcgggaaggcaggtgggggcctctccctggctggagcagggagctccaggagacctcaggacggcccccacccggtgggtaaggaccctgtttcccaatttgcccccaaggcctaatggacccaccgggcttagggagtcctcactcagaggagaggagcccacccctcccaggacacctggctgagccggaacagcagcgcaggggagctgtgacagcagagagcagcaccaggtcacacaagcagccgccccggaaggacacggcccatggtgacagaggacaagcagcatgcgtgtgtcagacactggcctggcctgtggacacgcccgcgtcccacagccatgaccctgcgaggccaggagagactgctccagggcacatgacctgtggtagctggaagtggggcagggaggcgcagccacactcctgctctggtccgagggagatctcaggaaaccgactgggaaatcaccccccacagggacccccacccctcccagcctcactgcgcccgtcaggccaggcagctgccctcagggtctgccaaggtgggggtcaggggccatgggggcaggtagctctgcctgcaaagcccacaagcatgtcagatcacctgggctgcagacagacaaacacctgagctgttctgaataccttcaggttcctggcctccctgagcaagtgcagaaatttttaccttcaaggatcagggtttttctgtttgtttgttttttaacacacatatatgtg

SEQ ID NO: 244 - DNA, 462 bp, Homo sapiens
gcctccccgctgcagcccccgcactccttcttcggcgcccagcaccgggaccctctccatttctacccctgggtcctgcggaaccgcttcttcggccaccgcttccaggccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtgaaggtgtggttccagaaccggaggacaaagtacaaacggcagaagctggaggaggaagggcctgagtccgagcagaagaagaagggctcccatcacatcaaccggtggcgcattgccacgaagcaggccaatggggaggacatcgatgtcacctccaatgactag

SEQ ID NO: 245 - DNA, 2908 bp, Homo sapiens
cgggcgccgcaggagcgagtgagctgggagcgaggggcgaaggcgcggagaagcccggccgcccggtgggcggcagaaggctcagccgaggcggcggcgccgactccgttccactctcggcccggatccaggcctccgggttcccaggcgctcacctccctctgacgcactttaaagagtctccccccttccacctcagggcgagtaatagcgaccaatcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaacttttttttttttttgcctcccccgagaactttccccccttctcctccctgcctctaactccgatccccccacgccatctcgccaaaaaaaaaaaaaaaaaaaaaaaagaaaaaaaaagaaaaaaaaagaaaaaaaattaccccaatccacgcctgcaaattcttctggaaggattttcccccctctcttcaggttgggcgcgtttggtgcaagattctcgggatcctcggctttgcctctccctctccctcccccctcctttcctttttcctttcctttcctttctttcttcctttccttccccccacccccacccccaccccaaacaaacgagtccccaattctcgtccgtcctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccgaaaggaagcagctggcacacagcctcagcctcacggaaactcaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggagggagagagagaaagagagagaaagagagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaacaaaaattccatatctagccccatcccacacctgtttcaaatccttgaaatgcatgtagcagttgttgggcgaatggtgtttaaagaccgaaaatgaattgtaattttcttttccttttaaagacaggttctgtgtgctttttattttgattttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagaatcaggacttgtactgggaaaaaaacccctaaattaattatatttcttggacattccctttcctaacatcctgaggcttaaaaccctgatgcaaacttctcctttcagtggttggagaaattggccgagttcaaccattcactgcaatgcctattccaaactttaaatctatctattgcaaaacctgaaggactgtagttagcggggatgatgttaagtgtggccaagcgcacggcggcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgccctcaaaaaaaaaaaaa

SEQ ID NO: 246 - DNA, 2962 bp, Homo sapiens
agctcacagacccataatcctgcatttctctaacaagttgtttatggagttgcttctccatttgcctacatcccaaaattcacccctcccgggtttcttctgccccctcctgagtcccggcctgaaggagggggagggacgcgggtgcgggcgcgggtgggggagggcggacccgacgcacagggccagcgccgaggcgccccctctccgccagcggttgacgcccccggattatttatccgcaaagtcccgcgcgcgcccattgggccgaggcccgagtgtcagcgcgagtcccggctcgccattggctccgcacacgtgcggccctgactcacgtgcttccggtttgaaggcaaaaagtgtgcctgggtgattttttttttaagcgagagagtttgtgcaaagatccgagctgtcagagatttgaaaaaaaaaaaaaaaaaaaaaaaaaaaaaaacagcccggcgctggcggagacgcgctctccctgcaaaaaaagcaaaggcgattaaaggcgctgccagcctcacgctctgggcacagctgagcgtgacactcggggaagtcaaacccctcactactgcctaggaagatggctagactttaaatactatttttttccctttaagaaaaaaattattggagctttttttcttgctttctttttccttttctttttctttttttccttcatttttttggccgtggcttactccccatttaaatcaaatcattgaatctggttgcagaaagaaaaaagaaatagccaagtgtctccatatctggatgtctacaaattagagagggagagacagcgagatctatctgctagataagaacgagcgatccaggccagacgcctgagcttttttcctgcacccgccccgtgccttcgctgaggcttcgcctgcctccttcctccgcgcacccccacgggccgctggcaaagtggggtggggagcgaggcggtgggggcgggggccggcgcggcggccggggcggcggggcggccgagcatggaagaacagcagccggaacctaaaagtcagcgcgactcggccctcggcgcggcggcggcggcgactccgggcggcctcagcctgagcctcagtccgggcgccagcggcagcagcggcagcggcagcgatggagacagcgtgccggtgtccccgcagcctgcgcccccctcgccgcccgcggcgccttgcctgccgcccctggcccaccacccgcacctccccccacaccccccgcccccgccgcctcagcatctcgcggcgcctgctcaccagccgcagccagcggcccagctgcaccgcaccaccaactttttcatcgacaacatcctgaggccggacttcggctgcaaaaaggagcagccgccaccgcagcttctggtggctgcggcggccagaggaggcgcaggaggaggaggccgggtcgagcgtgacagaggccagactgccgcaggtagagaccctgtccacccgttgggcacccgggcgccaggcgctgcctcgctcctgtgcgccccggacgcgaactgtggcccacccgacggctcccagccagccgccgccggcgcgggcgcgtctaaagctgggaacccggctgcggcggcggcggcggccgcggcggcagtggcggcggcggcggcggccgcagcagccaagccctcggacaccggtggcggcggcagtggaggcggcgcggggagccccggagcgcagggcaccaaatacccggagcacggcaacccggctatcctacttatgggctcagccaacggcgggcccgtggtcaaaactgactcgcagcagcctctcgtatggcccgcctgggtgtactgcacacgttattcggatcgtccatcctccggtccgcgcaccaggaagctgaagaagaagaagaacgagaaggaggacaagcggccgcggaccgcgttcacggccgagcagctgcagagactcaaggcggagttccaggcaaaccgctacatcacggagcagcggcggcagaccctggcccaggaactcagcctcaacgagtcccagatcaagatctggttccagaacaagcgcgccaagatcaagaaagccacaggcatcaagaacggcctggcgctgcacctcatggcccagggactgtacaaccactccaccaccacggtccaggacaaagacgagagcgagtagccgccacaggccggggccgcgcccgcgccccctcccggcaccgccgccgtcgtctcccggcccctcgctgggggagaaagcatctgctccaaggagggagggagcgcagggaaaagagcgagagagacagaaagagagcctcagaatggacaatgacgttgaaacgcagcatttttgaaaagggagaaagactcggacaggtgctatcgaaaaataagatccattctctattcccagtataagggacgaaactgcgaactccttaaagctctatctagccaaaccgcttacgaccttgtatatatttaatttcaggtaaggaaaacacatacgtgtagcgatctctatttgctggacatttttattaatctcctttattattattgttataattattataattattataattattttatcccctcccccaccgcctcgctgcccccgcccagtttcgttttcgttgcctttttcatttgaatgtcattgcttctccggtgcctcccgacccgcatcgccggccctggtttctctgggacttttctttgtgtgcgagagtgtgtttcctttcgtgtctgcccacctcttctcccccacctcccgggtcccttctgtcggtctgtctgttctgcccccctttcgttttccggagacttgttgagaaatacgaccccacagactgcgagactgaaccgccgctacaagccaaagattttattatgttcagaaacctgtagtctgaaataaagtgtacactgtgctcacga

SEQ ID NO: 247 - DNA, 3405 bp, Homo sapiens
tctctcatcgtctgggcgagcggggcggctcgtggtgtttctaacccagttcgtggattcaaaggtggctccgcgccgagcgcggccggcgacttgtaggacctcagccctggccgcggccgccgcgcacgccctcggaagactcggcggggtgggggcgcgggggtctccgtgtgcgccgcgggagggccgaaggctgatttggaagggcgtccccggagaaccagtgtgggatttactgtgaacagcatggaggagaatgaccccaagcctggcgaagcagcggcggcggtggagggacagcggcagccggaatccagccccggcggcggctcgggcggcggcggcggtagcagcccgggcgaagcggacaccgggcgccggcgggctctgatgctgcccgcggtcctgcaggcgcccggcaaccaccagcacccgcaccgcatcaccaacttcttcatcgacaacatcctgcggcccgagttcggccggcgaaaggacgcggggacctgctgtgcgggcgcgggaggaggaaggggcggcggagccggcggcgaaggcggcgcgagcggtgcggagggaggcggcggcgcgggcggctcggagcagctcttgggctcgggctcccgagagccccggcagaacccgccatgtgcgcccggcgcgggcgggccgctcccagccgccggcagcgactctccgggtgacggggaaggcggctccaagacgctctcgctgcacggtggcgccaagaaaggcggcgaccccggcggccccctggacgggtcgctcaaggcccgcggcttgggcggcggcgacctgtcggtgagctcggactcggacagctcgcaagccggcgccaacctgggcgcgcagcccatgctctggccggcgtgggtctactgtacgcgctactcggaccggccttcttcaggtcccaggtctcgaaaaccaaagaagaagaacccgaacaaagaggacaagcggccgcgcacggcctttaccgccgagcagctgcagaggctcaaggccgagttccagaccaacaggtacctgacggagcagcggcgccagagcctggcgcaggagctgagcctcaacgagtcacagatcaagatttggttccagaacaagcgcgccaagatcaagaaggccacgggcaacaagaacacgctggccgtgcacctcatggcacagggcttgtacaaccactccaccacagccaaggagggcaagtcggacagcgagtagggcggggggcatggaggccaggtctcagtccgcgctaaacaatgcaataatttaaaatcataaagggccagtgtataaagattataccagcattaatagtgaaaatattgtgtattagctaaggttctgaaatattctatgtatatatcatttacaggtggtataaaatccaaaatatctgactataaaatatttttttgagttttttgtgtttatgagattatgctaattttatgggtttttttcttttttgcgaagggggctgcttagggtttcacctttttttaatcccctaagctccattatatgacattggacacttttttattattccaaaagaagaaaaaattaaaacaacttgctgaagtccaaagattttttattgctgcatttcacacaactgtgaaccgaataaatagctcctatttggtctatgacttctgccactttgtttgtgttggcttggtgaggacagcaggaggggcccacacctcaagcctggaccagccacctcaaggccttggggagcttaggggacctggtgggagagaggggacttccagggtccttgggccagttctgggatttggccctgggaagcagcccagcgtaccccaggcctgctctgggaagtcggctccatgctcaccagcagccgcccaggcccgcagcctcacccggctccctctcctcaccctcctgcacctaactccctcctccttctcctttttcctcctcttcctccttcctccttcctcctgctcctcctttcttcttctttttcttctcctcctcctccttccttcctcctcctccttctctttcctcctcctcctcaccaagggcccaaccgtgtgcatacatcgtctgcgtctgtggtctgtgtcgctgtccccagtcccaccgcagtcctgccgcaggcctaaccctcctgccctgggcactgcctccatgcagaagcgcttcgaggttctggggctaaaggcctggggtgtgtggcctaaagcccaagagcggtggggcgaccctccttttggcttggccccaggaatttcctgtgactccaccagccatcatgggtgccagccagggtcccagaaatgaggccatggctcactgtttctgggcgggcagaaggctctgtagagggagatggcatcatctatcttcctttcctttttcttttcttccctatttttttctttttttcctttatttttttcttttcttggagtggctgcttctgctatagagaacattcttccaagataaatatgtgtgtttacacatatgtctgcatgcatgtgaacacacacacacacacacacacaccaggcgtgtttgagtccacagttctgaaacatgtggctaccttgtctttcaaaagaactcagaatcctccaggatctagaagaaggaagaaagtgtgtaaataatcatttcttatcatcactttttgtcttttcttgttttttaaaatatacattttatttttgaaggtgtggtacagtgtaaattaaatatattcaatatatttcccaccaagtacctatatatgtatataaacaaacacattatctatatataacgccacactgtcttctgtttagtgtatggggaaagaccaatccaactgtccatctgtggctgggacagcccagggggtgtgcccacggctgacccaggggtgtgcacacggctgagctgggagtcccgctggtctccctgaggactgagggtgaacttcgctctttgccttaaacctctttatttcattgcagtaatagttttacgttgtacataatagtgtaaacctttttaaaaaggaaagtataaaaacaaaagttgtaatttaaaagtctgaataaccatctgctgcttaggaaactcaatgaaatgacatgcctttttagcaggaagcaaagttggtttctgttttttgttttctttgttgttttagtttataaaacatgtgcattttacagttccagtatcaaatatttataatcttatgagaaatgaatgaatgtttctatttacaactgtgcttatcaaaattgtgaacacccccacccccgcatttttgtgtgttgaaattcttgaaggttacattaaataaaacaaaatctctttattataaaataaaaaaaaaaa

SEQ ID NO: 248 - DNA, 5559 bp, Homo sapiens
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcagataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcaaaaaaaaaaaaaaaaaaaaaaaaaaaaaaaaaaaaaaaaaaa

SEQ ID NO: 249 - DNA, 1812 bp, Homo sapiens
tagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgag

SEQ ID NO: 250 - DNA, 2756 bp, Homo sapiens
atgcagttaggggagcagctcttggtgagctcagtgaacctgcctggcgcgcacttctacccgctggagagtgcgcgaggcggcagcggcgggagcgctggccacctccccagcgcggccccctctcctcagaagttggacttagacaaagcgtccaagaagttttccggcagtctctcctgcgaggcggtgagcggggagcccgcagccgccagcgcaggggcccccgcggccatgcttagtgacaccgacgccggggacgcatttgccagcgctgcggcagtggccaagccggggcccccggacggccgcaagggctccccctgcggggaggaggagctgccctccgccgctgcagccgccgccgccgccgccgccgcggctgcggccactgcgcgctactccatggacagcctgagctccgagcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgtgtgcccacccgggagggcgcagttcggcccaggagccggtgcgggcagtggcgcgggcggtagcagcggcgggggcggcggcccgggcacctatcagtacagccagggggctccgctctacgggccgtaccctggagccgcagcggcgggatcttgcggaggactggggggcctgggggttccaggttctggcttccgtgcccacgtctacctgtgcaaccggcctctgtggctcaaattccaccgccaccaaactgagatgatcattacgaaacagggcaggcgcatgtttcctttcttgagcttcaacataaacggactcaatcccactgcccactacaatgtgttcgtagaggtggtgctggcggaccccaaccactggcgcttccaggggggcaaatgggtgacctgtggcaaagccgacaataacatgcagggcaacaaaatgtatgttcacccagagtctcctaatactggttcccactggatgagacaggagatttcattcgggaaattaaaactcaccaataacaaaggcgcaaataacaacaacacccagatgatagtcttacaatccttacacaaataccaaccccgactgcatattgttgaagttacagaggatggcgtggaggacttgaatgagccctcaaagacccagacttttaccttctcagaaacgcaattcattgcagtgactgcctaccaaaacaccgatattactcaactaaagattgatcataacccctttgcaaaaggcttcagagacaactatgattcatcccatcagattgtccctggaggtcggtacggcgttcaatccttcttcccggagccctttgtcaacactttacctcaagcccgctattataatggcgagagaaccgtgccacagaccaacggcctcctttcaccccaacagagcgaagaggtggccaaccctccccagcggtggcttgtcacgcctgtccagcaacctgggaccaacaaactagacatcagttcctatgaatctgaatatacttctagcacattgctcccatatggcattaaatccttgccccttcagacatcccatgccctggggtattacccagacccaacctttcctgcaatggcagggtggggaggtcgaggttcttaccagaggaagatggcagctggactaccatggacctccagaacaagccccactgtgttctctgaagatcagctctccaaggagaaagtgaaagaggaaattggctcttcttggatagagacacccccttccatcaaatctctagattccaatgattcaggagtatacaccagtgcttgtaagcgaaggcggctgtctcctagcaactccagtaatgaaaattcaccctccataaagtgtgaggacattaatgctgaagagtatagtaaagacacctcaaaaggcatgggagggtattatgctttttacacaactccctaaagagttattttaacctcaaaaattagctaactttttgcagatggacttggtggtgttttttgttgtcttctttgcctaggttgccaaaaagatgtttgccttccaccttgatgcatcctgttttgtgcaattctctaaaagaaggtgccaaagctttttgattgctgcaggtaactgaaacaaacctagcatttttaaaaaataagattaatggaagactttaaggtattttaaaattcgaagggtatccaaggttctgtatttatttattggggagacactaacccttcaaagaagcaggctgtgaacattgggtgcccagtgctatcagatgagttaaaacctttgattctcatttctatttgtaaattcttaagcaaatagaagccgagtgttaaggtgttttgcttctgaaagagggctgtgccttccgtttcagaaggagacattttgctgttacattctgccaggggcaaaagatactaggcccaggagtcaagaaaagcttttgtgaaagtgatagtttcacctgactttgattccttaacccccggcttttggaacaagccatgtttgccctagtccaggattgcctcacttgagacttgctaggcctctgctgtgtgctggggtggccagtgggactcaggagagagcaagctaaggagtcaccaaaaaaaaaaaaaaaaaaaaaa

SEQ ID NO: 251 - DNA, 2751 bp, Homo sapiens
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaaccagta

SEQ ID NO: 252 - DNA, 7006 bp, Homo sapiens
agcagaagtcggagtcgctgttgggggcggtgtctatggttgagctgagggcgcaggcgccacggcccgtcgagctgggttccaaggcggctggcggcggtagcgtctctgtttccttgtgggcgctcgcgcggccctgggtagtctgtagagaatgccaaatgagggaatcccccactcaagtcaaactcaggagcaagactgtttacagagtcaacctgtcagtaataatgaagaaatggcaatcaagcaagaaagtggtggtgatggggaggtggaggagtacctctcctttcgttctgtgggtgacgggctgtccacctctgctgtggggtgcgcatcagcagctccgaggagagggccagccctgctgcacatcgaccgacatcagatccaggcagtagagcctagcgcccaggcccttgagctgcagggtttgggtgtggacgtctatgaccaggacgtgctggaacagggagtgcttcagcaggtggacaatgccatccatgaggccagccgtgcctcccagctcgttgacgtggagaaggagtatcggtcggtcctggatgacctcacgtcatgtacgacatccctaaggcaaatcaataaaattattgaacagcttagccctcaagctgccaccagcagagacatcaacaggaaactagattctgtaaaacgacagaagtataataaggaacaacagctaaaaaagatcactgcaaaacaaaagcatctccaggccatccttggaggagcagaggtgaaaattgaactagatcacgccagtctggaggaggatgcagagccggggccatccagtcttggcagcatgctcatgcctgtccaggagactgcctgggaagagctcatccgcactggccagatgacaccttttggtacccagatccctcagaaacaggagaaaaagcccagaaaaatcatgcttaatgaagcatcaggcttcgaaaagtatttggcagatcaagcaaaactgtcttttgaaaggaagaagcaaggttgtaataaaagagcagctagaaaagctccagccccagtcacgcctccagccccagtgcaaaataaaaacaaaccaaacaagaaagccagagttctgtccaaaaaagaggagcgtttgaaaaagcacatcaagaaactccagaagagggctttgcagttccaggggaaagtgggattgccaaaggcaaggagaccttgggagtcagacatgaggccagaggcagagggagactctgagggtgaagagtctgagtatttccccacagaggaggaggaagaggaggaagatgacgaggtggagggggcagaggcggacctgtctggagatggtactgactatgagctgaagcctctgcccaagggcgggaaacggcagaagaaagtgccagtgcaggagattgatgatgactttttcccaagttctggggaagaagctgaagctgcttctgtaggagaaggaggaggaggaggtcggaaagtgggaagataccgagatgatggagatgaagattattataagcagcggttaaggagatggaataaactgagactgcaggacaaagagaaacgtctgaagctggaggacgattctgaggaaagtgatgctgaatttgacgaaggttttaaagtgccaggttttctgttcaaaaagctttttaagtaccagcagacaggtgttaggtggctgtgggaattgcactgccagcaggcaggaggaattctgggagatgaaatgggattgggcaagaccatccagataattgccttcttggcaggtctgagctacagcaagatcaggactcgtggttcaaattacaggtttgaggggttgggtccaactgtaattgtctgtccaacaacagtgatgcatcagtgggtgaaggaatttcacacgtggtggcctccgttcagagtggcaattctacatgaaaccggttcctatacccacaaaaaggagaaactaattcgagatgttgctcattgtcatggaattttgatcacatcttactcctacattcgattgatgcaggatgacattagcaggtatgactggcactatgtgatcttggacgaaggacacaaaattcgaaatccaaatgctgctgtcacccttgcttgcaaacagtttcgcacccctcatcggatcattctgtctggctcaccgatgcaaaataacctccgagagctgtggtcgctctttgacttcatcttcccgggaaagttaggcacgttgcctgtgtttatggagcagttctccgtccccatcaccatggggggatattcaaatgcttccccagtacaggtcaaaactgcttacaagtgtgcatgtgtcttacgagataccataaatccatacctactgcggagaatgaagtcagatgtcaagatgagcctttctttgccagataaaaatgaacaggtcttattttgccgtcttacagatgagcagcataaagtctaccaaaatttcgttgattccaaagaagtttacaggattctcaatggagagatgcagattttctccggacttatagccctaagaaaaatttgcaaccaccctgatctcttttctggaggtcccaagaatctcaaaggtcttcctgatgatgaactagaagaagatcagtttgggtactggaaacgttctgggaaaatgattgttgttgagtctttgttgaaaatatggcacaagcagggtcagcgagtattgctgttttctcagtcaaggcagatgctggacatacttgaagtattccttagagcccaaaagtatacctatctcaagatggatggtaccactacaatagcttcaagacagccactgattacgagatacaatgaggacacatccatatttgtgtttcttctgaccacgcgggtgggcggcttaggtgtcaacctgacgggggcaaacagagttgtcatctatgacccagactggaacccaagcacggacacgcaggcccgggagcgagcatggagaataggccagaagaagcaagtgactgtgtacaggctcctgactgcgggcaccattgaagaaaagatctaccaccgacaaatcttcaagcagtttttgacaaatagagtgctaaaagacccaaaacaaaggcggtttttcaaatccaatgatctctatgagctatttactctgactagtcctgatgcatcccagagcactgaaacaagtgcaatttttgcaggaactggatcagatgttcagacacccaaatgccatctaaaaagaaggattcaaccagcctttggagcagaccatgatgttccaaaacgcaagaagttccctgcttctaacatatctgtaaatgatgccacatcatctgaagagaaatctgaggctaaaggagctgaagtaaatgcagtaacttctaatcgaagtgatcctttgaaagatgaccctcacatgagtagtaatgtaactagcaatgataggcttggagaagagacaaatgcagtatctggaccagaagagttgtcagtgattagtggaaatggggaatgttcaaattcttcaggaacaggcaaaacttctatgccatctggtgatgaaagcattgatgaaaagttaggtctttcttacaaaagagaaagacccagccaggctcaaacagaagctttttgggagaataaacaaatggaaaataatttttataagcacaagtcaaaaacaaaacatcatagtgtggcagaagaagagaccctggagaaacatctgagaccaaagcaaaagcctaagaactctaagcattgcagagacgccaagtttgaaggaactcgaattccacacctggtgaagaaaaggcgttaccagaagcaagacagtgaaaacaagagtgaggccaaggaacagagcaatgacgattatgttttggaaaagcttttcaaaaaatcagttggcgtgcacagtgtcatgaagcacgatgccatcatggatggagccagcccagattatgtactggtggaggcagaagccaaccgagtggcccaggatgccctgaaagcactgaggctctctcgtcagcggtgtctgggagcagtgtctggtgttcccacctggactggccacagggggatttctggtgcaccagcaggaaaaaagagtagatttggtaagaaaaggaattctaacttctctgtgcagcatccttcatcaacatctccaacagagaagtgccaggatggcatcatgaaaaaggagggaaaagataatgtccctgagcattttagtggaagagcagaagatgcagactcttcatccgggcccctcgcttcctcctcactcttggctaaaatgagagctagaaaccacctgattctgccagagcgtttagaaagtgaaagcgggcacctgcaggaagcttctgccctgctgcccaccacagaacacgatgaccttctggtggagatgagaaacttcatcgctttccaggcccacactgatggccaggccagcaccagggagatactgcaggagtttgaatccaagttatctgcatcacagtcttgtgtcttccgagaactattgagaaatctgtgcactttccatagaacttctggtggtgaaggaatttggaaactcaagccagaatactgctaaacaacattgcttcctaaactttcaagtccctttttctaacgggcatttctgattattaatttattattaataatcatgtttgtcaatggaagttggctgcacttgatgtttgtttgcatgatgtctacctcagaattaaaactttaaggaagaagaaactcttctctgaaagttaaaagttttaataatgctagctaaaggagaaaatacttggattgatttttttttttttggcaatctaattatattgtaaatcaggtacctaacagttactccttggagcacatttgttcctttacccaaaagatgctgtcagggagcacagttagaagtttgcagaacagaaatctcaatatttttttttattggtgctaaaaacaggtcttacattcagtcagacctgttcaataagttcatcaatatctgataacagcattattttgatgcttaaactttaaacatttatatttaccatttgccacccacaaaggtcaggtttgttatttgttgtttgataattatattaattttcttggaaagatcctcttttcaaggtactggtaaattggtgagtatttttattagtaaagcatgaaatagtatggtaataaatgataagacatgtatttgtggaaagctgtagggtattcagtttaccctggctttcctttaagcagagggcatctttttctctcctacagtcacaaaatgtgttatcattaaaaaaaatcaaattaaagccaaaagtaggtacataaaaaccacacacatgcatgcacacaaacatcactgcagcccacagcagacccagccgttgttaccatgaagtgacaccactccaggcctctcttgtctgcaggctggcaggctgtcttctctccagttgccttcgtcttgcgcctgcctttgcattccttgcgacgggctttcttgtttctgcggtttggattccagccaaggctgtttgtatctcactactgtttatgtgtttgtggttctgtgatggtgttgctttgatcctcagtttattttcttacccatgtttttcttgtttccttctcaggatgattttatcatctcatctttgaagtgttgttttccgaaattcatcgtattcctgaaatttcttcttagctgtcttagtgcagtttgtttcttggatttgtattctctggcatgctcttttcctctctctcatttttctgtagtatgcctgccctcctaccctgctatttctttacatctctctcatgcttaacatggatagctgtgtccagatcttctgtctgctcatccatgtgactcagagaggagggttctgggcaggggggccttgccggactgcatgagaggacatgagttttgctttctctgctctaatattttgcttaagccaagaatccttttcttagagatgttctatatgattcctgtcaggattttctagttttttttggattatagcttgttcatttcttttgtttttagtttggtttatatataatgagggaagaagatgattacattatttttgtcactttgccatcattgtttagaagtcatagaaagaatttttaaataggccaataagtcttaaacttgagtacttggcttagaagaaagtcaaaactccttcctttttgactaagtggtttgtttctggggagctcttaatttctatttttataatcattagcctataaggaaattgtgtcttccttgttctcagggtgatctgctgaccttgttcactcatgaagcatttgggtatcatacttatagtgtctgaaacataaactgtattgagctagacaaggtatagcctcctcttcaagtagcaaatactatcaaaagctataatgcagtaggagcaaggtggtccttgttccagtttttgtctcagttctgctgctgatgtaccatgatcttgggaaggtggtgtctcagtgtggagatctgacacattgttaccgtgcctcctggctggagggacttggagaacaatgcagttaagtagaatggttttaacaatacagagaaatttattcatttagataaaaatctgatttttagaactttaaaagctttgtacagtgtaaatagatttaatgtatttaacatgctttatcagcacaaataaaggattttaaaattttgtcaaaaaattaaatgttaatactatcaccattaaaaatgttcaagcaatagtctgcctccccacccccacaccatcttgcacctgttccacagctaagtacagccctaggtttggtgtgtattctccatgcatttagagaatcacatgacacagactgctgctataatgtcattttcccattcttcctttactaataaaatttttgagtttta

SEQ ID NO: 253 - DNA, 2705 bp, Homo sapiens
attaacccgggaggcggcggcggggaggggagaggctctgagaggcgaggccgggtgaggcggcgagggcggcccgacgggcgcgggacgggacggggcagcgagggcgccgggagccgcggcccggaatcggggcgcttcgccccgggccccccagcatgaagaccccggcggacacagggtttgccttcccggattgggcctacaagccagagtcgtcccctggctcaaggcagatccagctgtggcactttatcctggagctgctgcggaaggaggagtaccagggcgtcattgcctggcagggggactacggggaattcgtcatcaaagaccctgatgaggtggcccggctgtggggcgttcgcaagtgcaagccccagatgaattacgacaagctgagccgggccctgcgctattactataacaagcgcattctgcacaagaccaaggggaaacggttcacctacaagttcaatttcaacaaactggtgctggtcaattacccattcattgatgtggggttggctgggggtgcagtgccccagagtgccccgccagtgccgtcgggtggtagccacttccgcttccctccctcaacgccctccgaggtgctgtcccccaccgaggacccccgctcaccaccagcctgctcttcatcttcatcttccctcttctcggctgtggtggcccgccgcctgggccgaggctcagtcagtgactgtagtgatggcacgtcagagctggaggaaccgctgggagaggatccccgcgcccgaccacccggccctccggatctgggtgccttccgagggcccccgctggcccgcctgccccatgaccctggtgtcttccgagtctatccccggcctcggggtggccctgaacccctcagccccttccctgtgtcgcctctggccggtcctggatccctgctgccccctcagctctccccggctctgcccatgacgcccacccacctggcctacactccctcgcccacgctgagcccgatgtaccccagtggtggcggggggcccagcggctcagggggaggctcccacttctccttcagccctgaggacatgaaacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccactcggacgccggcagcgggcagctggggagaaggccgtagccggtgctgacaagagcggtggcagtgcaggcgggctggctgagggggcaggggcgctagccccaccgcccccgccaccacagatcaaggtggagcccatctcggaaggcgagtcggaggaggtagaggtgactgacatcagtgatgaggatgaggaagacggggaggtgttcaagacgccccgtgccccacctgcaccccctaagcctgagcccggcgaggcacccggggcatcccagtgcatgcccctcaagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgccctggaggtgagggcagctctcttgtctcttccctgcctcctcccttttccctccccacattttgtataaaactttaatttcttttttttaaaaatggtgggggtgggtgggtgcccagggctaggggctattccctgtctctgtgggtttctaagctctgggcaaagtggtggtagggggagggagggggaagttaagggggtcacctccattctggggaatttatatttgaattgaggctttggccttaacacccaggaacttttctattacaatcgcttaggaagtaaagccttgtctccctccctgttctctgcctcttgtacccctctgacccacccgctctgccccactcccagccctcctcagccccagccctgcctgccctgcccctccagggggccatgagtgcctaggtttctcataccccacaaggtcacagcaggggagggagggacaattttataatgaaccaaaaattccatgtgttggggggtggggggcggaggagggtgaggggtgccgcccatgggccacaaatctctacaagtgcctgctatccctctcccactccccaccccagcaccggtccaaccccttcatccccagctgctcctaggactggcccatgggcaggcgggtggggggatgggaagggggtgccctgaaaccaaactggaagccccctctgcctcccagctggggcctctggggtggggtggggggctgtggtcaagccttattctgtattggggactgagggtggggggagtagaggggccgctggagaatgtattcaaaacaataaaactttggacctttggatgca

SEQ ID NO: 254 - DNA, 5042 bp, Homo sapiens
gttttcacttggtcggaatggggagagtgtgcaagagatcgctgcgggacaggttcctagagatcgctccgggacggtcgtgacggcccccgagggacatgagagaagaggagcggcgctcaggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaaaaaaa

SEQ ID NO: 255 - DNA, 6330 bp, Homo sapiens
aggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaa

SEQ ID NO: 256 - DNA, 2169 bp, Homo sapiens
ctcggtctttaaaaggaagaaggggcttatcgttaagtcgcttgtgatcttttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagtaacaagggcatggaacatctgctcaacatgaagtgcaaaaatgtggtcccagtgtatgacctgctgctggagatgctgaatgcccacgtgcttcgcgggtgcaagtcctccatcacggggtccgagtgcagcccggcagaggacagtaaaagcaaagagggctcccagaacccacagtctcagtgacgcctggccctgaggtgaactggcccacagaggtcacaggctgaagcgtgaactccagtgtgtcaggagcctgggcttcatctttctgctgtgtggtccctcatttgg

SEQ ID NO: 257 - DNA, 2221 bp, Homo sapiens
tcctacaagcagccggcggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctc

SEQ ID NO: 258 - DNA, 3029 bp, Homo sapiens
ccgcagagaggtgtggtcagggacatttcccctggccgggagcccatggagcactgtcctcagagatgcgcaggttaggctcactgtctaggccaggcccaccttagtcactgtggactggcaatggaagctcttcctggacacacctgccctagccctcaccctggggtggaagagaaatgagcttggcttgcaactcagaccattccacggaggcatcctccccttcctgggctggtgaataaaagtttcctgaggtcaaggacttccttttccctgccaaaatggtgtccagaactttgaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatctctggctcaccatgtaacatctggcttggagcaagtgggtgttctgcacaccaggcagctgcacctcactggatctagtgttgctgcgagtgacctcacttcagagcccctctagcagagtggggcggaagtcctgatggttggtgtccatgaggtggaagctgcttttatacttaaaactcagatcacaacaggaaatgtgtcagtaacaatggaactccatccaatgggaaagttcctggtactgaaggggtccattggacactcagaaaagaagttcaggggccaacttcttagctggaatcctggccagatgaggaccctctccggggaagggagaggactgacttagtggaaggtggtgaagtgaggagagtttaggggaaccttcccccagtggaacagatctcaagtttaccctaaacctgccatttctggaaaatctgtaaagaggaaacagcctgtctcagctgtactctcatgatacaggtcatttgaaatgaaccaagaaataaaacatgaaaatccaaccatggagaaggtggtatggctgggttttgtttggtccccttgtccttatacgttctaaagtttccagactggctttgtcactttgtgaactcgtcatgtgtgaaaaccaatctttgcatatagggaacttcctcgggccacactttaagaaccaagtaagaggctctcaagactccagcagagtcgggaggccatggcagcgccttagaggagctggaacctgcacccacctgtgtcggtggggggggcctcctttccccatagactctgccctccctctgtgcagatggaagtggcaggggagggtgaccagcttgtgacaagaagactgaagggtccagagtccatgctcacggaacagcaccaaagaaaagcactatgtggaaagattgttttattttctaataatgataatatggctggaatggcttcttaagatgtatatattttttaaaatggcagttccccattgcagcatcacctacttgtatgtctttctgcctctgtatatgttctcccagaaacccccatgtaaatcaaatgccctaggatgcttccatcctggtcccatgtatctggaatctaataaataaggaaaggaaaaaaaaaaaaaaaaa

SEQ ID NO: 259 - DNA, 5253 bp, Homo sapiens
aatcggggctttaagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagagcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttttgactgctaaaaaaaaaaaaaaaaa

SEQ ID NO: 260 - DNA, 1591 bp, Homo sapiens
cccgggatcgccgcggaaccacgcacagagtctgcagaagtgcacagctttatcgacagcgcttgaagcatggagtctcttcgcgggtacacccacagtgatattggctaccgcagcctggcagtcggcgaggacatcgaggaagtgaatgatgagaaacttaccgtgacctcgctgatggcaaggggaggagaggacgaggagaatacacggtccaaacctgagtacggaacagaagcggaaaacaacgttggcacggaagggtccgtcccctcggacgaccaagaccgtgagggtggcggcggccacgagccggagcaacagcaggaggagccgcccctgaccaagccggagcaacagcaggaggagccgcccctgctcgagctgaagcaagagcaggaggagccgccccagacgaccgtggaggggccacagccggcggaggggccacaaaccgctgagggaccacagcccccagagaggaaacgccgccgccgcaccgcgttcacgcagtttcagctgcaggagctagagaactttttcgatgaatctcaatatcccgacgttgtggcgcgagagagacttgcagcacgcctgaatttgactgaagacagagtgcaggtttggtttcagaacagaagagccaagtggaaacgaaatcagagggtgctaatgttgagaaacactgctactgctgacctggcccaccctttggacatgttcttgggtggggcctattatgctgctcctgctctggatcctgctttgtgtgttcatctggtgccacaactacctagaccacctgtgctgcctgtgccacctatgccacccaggccacccatggtccctatgccacccaggccacccatagcacctatgccacccatggcgcctgtgccacccggctcacgcatggcgcctgtgccacccgggccacgcatggcgcctgtgccaccctggccgcccatggcgcctgtgccaccctggccgcccatggcgcctgtgccaaccgggccgcccatggcgcctgtgccacccgggccgcccatggcgcgtgtgccacccgggccgcccatggcgcgtgtgccacccgggccgcccatggcgcctctgccacccgggccgcccatggcgcctctgccacccgggccgcccatggcgcctctgccacccgggccgcccatggcgcctctgccacccaggtcacatgtgcctcacactggcctggctcctgtacacatcacatgggcccctgtcatcaacagttattatgcatgtccctttttctaaagtaaggtattcataacagtttttccaaagttctttcctgccagatagaaattgtgcacagcacagcatcaagtaattcgttagatgcttgttaaatgaagtgggtaggtgaacaaagttaacgaatgccctgttatttttgtaggccacataattgtagtattttcaataaagatgtgacttaatagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 261 - DNA, 2088 bp, Homo sapiens
ggtccgagttcggaatttcggttcaaggcccagttcctcggattgttcctgcgcaacttcagtttcccttccaggcacgggcaatgagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaaaaaaaaaaaaaaaaaaaaaaaaaaaaaaaaaaaaaaaa

SEQ ID NO: 262 - DNA, 5242 bp, Homo sapiens
gagatcgagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgaggaaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtgtgtgtgtgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataatgct

SEQ ID NO: 263 - DNA, 3672 bp, Homo sapiens
gcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggactcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccagtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccaggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattattataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatataaa

SEQ ID NO: 264 - DNA, 6824 bp, Homo sapiens
aaggaaaccagcccaatagtggacctaacaccccaataatgggaactggcgactcgaaacacacggtttcagtatccccaggcgccttaacaataagcagcgggttacagaggaaatcgagtctctccgtggcgcttccaggctgaggacccagcgcctaccggccgagcaccccctagggcagaggggcgagggagacccgcgggaaggggcagcaagccgcctgattgacagcccgaaatctgatcttgtgaaagagacgcggagccaatgggaggcagcgatccatcagtttggattggaggcccctggaggagaagtagaggaaaaaccaccgaattgagctctgtcagaggcgctttcggcttccaagggggaagtgctgggctataattaatgtttttattaaatttggagggaagtttttgcagcctttcgcctagcgtggccttcagtcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactgaaaaaaaaaaaaaaaaaa

SEQ ID NO: 265 - DNA, 435 bp, Homo sapiens
gcaccacctctttgaagcggtaccagagctcagctttcaccgtttgctccgaaccgagcccgcagtcggaccgtgccagtttggctcgatgccccaaaactaaccaccgaggtcccattcagctgtggcagttcctcctggagctgctccacgacggggcgcgtagcagctgcatccgttggactggcaacagccgcgagttccagctgtgcgaccccaaagaggtggctcggctgtggggcgagcgcaagagaaagccgggcatgaattacgagaagctgagccggggccttcgctactacttacgccgcgacatcgtgcgcaagagcggggggcgaaagtacacgtaccgcttcgggggccgcgtgcccagcctagcctatccggactgtgcgggaggcggacggggagcagagacacaataaaattccgtca

SEQ ID NO: 266 - DNA, 855 bp, Homo sapiens
cccggagacgccgcggaggagaccggaccgaagacggaccgtgccgggaagagcaggcgggtgaaaatgaaagccggctgtagcatcgtggaaaagccagaaggaggtggagggtatcagtttcctgactgggcctacaaaacagagtcatccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcagatactattacaacaagaggatccttcataaaacaaaagggaaaagatttacctataaatttaacttcaacaagctggtgatgcccaactacccattcatcaacattcggtcaagtggtgtggttcctcagagtgcaccaccagtgccaacagcctcttcccggttccatttcccacctctggacacccattctccaaccaatgatgtgcagccgggacggttctctgctagctcccaactgcttctggccaggagtccagtaatggtactgatagaaagactgagctttcagagctggaggatggctcagctgctgactggcgccggggtgtggatcccgtgtcctccaggaatgccattggtggaggagggattggccatcagaaacgcaagcctgacataatgcttcctctgtttgctaggccagggatgtaccctgacccccacagtcccttcgctgtctctccaatccctggccgcggaggtgtccttaatgtcccctagg

SEQ ID NO: 267 - DNA, 2298 bp, Homo sapiens
cacgttcttatgtaaccgagcccgggtaaagcagggctgcagaaagcagaaacggcgagcccggctcctgggagcaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccattaaaaaaaaaaaaaaaaaaaaaaaaaaaaaaaaaaaaaaaa

SEQ ID NO: 268 - DNA, 4102 bp, Homo sapiens
agcctggttggcagctgcggcgcagagtccagccgctggtgcgcggagcggttcaccgtcttcggagcggttcggcccagcctttcgcccaggcgcccaggcccgctgcgcgcgtgcgtgagcgcgcctgcgccgccggggccgctgcaaggggaggagagaggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaagggctctgatttgcacaatttgttgaaaaatcacaaacccatagaaaagtaagtaggctaagttggggaggctcaaaccattaagggttaaaaatacatcttaaacattggaaagctcttctagctgaatctgaaatattaccccttgtctagaaaaaggggggcagtcagaacagctgttccccactccgtggttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaactgtgcactgtgtcctttagccagggccgtgccaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttacgtgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttcttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcccctgcgcagggccgtatgcatcctgccaagctgcgttatattctgtactgtgtacaataaagaagtttgcttttcgtttaccaa

SEQ ID NO: 269 - DNA, 5989 bp, Homo sapiens
gcgtcccgggtccccgcgccgcgccgcgacctgcagaccccgccgccgcgctcgggcccgtctcccacgcccccgccgccccgcgcgcccaactccgccggccgccccgccccgccccgcgcgctccagacccccggggcggctgccgggagagatgctggaagaaacttcttaaatgaccgcgtctggctggccgtggagcctttctgggttggggagaggaaaggaaagtggaaaaaacctgagaacttcctgatctctctcgctgtgagacatgtctgagactcctgctcagtgtagcattaagcaggaacgaatttcatatacacctccagagagcccagtgccgagttacgcttcctcgacgccacttcatgttccagtgcctcgagcgctcaggatggaggaagactcgatccgcctgcctgcgcacctgcgcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcaggtgatgtgctctatgaactccttcagcatattctgaagcagaggaaacctcggattcttttttcaccattcttccaccctggaaactctatacacacacagccggaggtcatactgcatcagaaccatgaagaagataactgtgtccagaggacccccaggccatccgtggataatgtgcaccataaccctcccaccattgaactgttgcaccgctccaggtcacctatcacgacaaatcaccggccttctcctgaccccgagcagcggcccctccggtcccccctggacaacatgatccgccgcctctccccggctgagagagctcagggacccaggccgcaccaggagaacaaccaccaggagtcctaccctctgtcagtgtctcccatggagaataatcactgcccagcgtcctccgagtcccacccgaagccatccagcccccggcaggagagcacacgcgtgatccagctgatgcccagccccatcatgcaccctctgatcctgaacccccggcactccgtggatttcaaacagtccaggctctccgaggacgggctgcatagggaagggaagcccatcaacctctctcatcgggaagacctggcttacatgaaccacatcatggtctctgtctccccgcctgaagagcacgccatgcccattgggagaatagcagactgtagactgctttgggattacgtctatcagttgctttctgacagccggtacgaaaacttcatccgatgggaggacaaagaatccaaaatattccggatagtggatcccaacggactggctcgactgtggggaaaccataagaacagaacaaacatgacctatgagaaaatgtccagagccctgcgccactactacaaactaaacattatcaggaaggagccaggacaaaggcttttgttcaggtttatgaaaaccccagatgaaatcatgagtggccgaacagaccgtctggagcacctagagtcccaggagctggatgaacaaatataccaagaagatgaatgctgaaggaaccaacagtccacctcagcgggccagcagcccagggaacccctgcccaccaggattgctggaagtgtgacggagcaggcgggctgaggagagtggaaaaggaagcgacccagaaatggcagggacacttctcttgcagaccaagagggaccctggagcaccttagacaaactacccagcacaggcggggctggaattctggcggagggcatgagcctgggactccatgtcacgtttccttctgatttggaatctctccatctgtaattcctcaccctcacccttccaccgttgttagtatcatggtgtttttgtttttgtttttgttttaagaacctgcagtttgactcttcatcgttcatctaggggaagacatctgatgttgttttcctatggaaatatatatctattatatatatattttttgcaaatctcacaaagtgcggcaagcccagctggtcaggaaagagaatacttgcagaggggttcaggttcctctttttcctgccacgtggatcaggtctgttcctgttactgttgggtcttggctgaaaaaaaaaaatgcttttaaaaaagataaaatgaaaaggagagctctctttttctctctcttgctctgttcttcccttggtcccctctgtcctcccgccctgcctgcagttgagattcagatgccttctgacagagttcagcctcttggagagtcttggggattgttggcacctaaacagaatcagtgacccgggtgctttgtggccagcagcacagaatcaaacccgcatcccagcattgggccacccatctgagggaggccaaaatcatcacagatgctgctgtgctgcagacagatacatgctagtccagagagccgcccctgagatggctgtgagaaccatgtgtctaaggcgtaagataaggatggaaggctgtccaagttatttggaaggcctcggcagcttgggattagcttgggagcgcagcgctgcaaagtggaaaatatgaaaagaccacacaggcccagcagtccagaaactgggcaaaaatattctgcagtggggatttatttttccaaagcaggtaacagaggctagtgagaaagaaaagctcctctctgctccattccaaaggccatcttgtggtcagtttcatgccctcacctgatttttttttttttttttttttttcaattcctaaccttttttaaagtttcctggtctccactggacacagagctttggagacggaggatcccagagggcagtctcagttgcaatcagtgtgtgcccagcctgggcagacaggaaattcctcggatacattattttttctttctttcatagctgtgtctcagaaaggacccatttgtggctctttttcacctcaaaataagatcgatggtatcttgtaaaatgagggtagtgccacttcttagtatttttgaaagctgttttagattttttttttttttccttttctagccatctaaattgactcttccaatataggtctcagaaatccaatatttggagtacaatttcttttaatccagattacacctgccttacaaagcaccccctccttgttcccctctgtttcctctactcagttgggggagaaactcacagctcctccgggatacatatgtgccctcagcagcagctcccaggtgaagttaccagacccctgggcttctccccagctttttctgagttgagtcagacatgtagagtttgggtcacacaggcaagaggaattttccctcggccttactgacaaggacaccaacctagggtgcaaacagatggactatggttcaaggacactggaattgaggagctgatcaaggctctcttcagccttgctctgtccctgcctcttatcagagcacaggtagacacacgggcatagccagcccactcctactgtcacaggcgccccaccattcaaccttccgggaggtcagggaccttctatatgaggcgagtgggtctcagtctgcttgaatggtgatgagattctgctggatctcagcacgctgcaggtgtcttttgagagcattcagtaggacatggtgatccctatttcagcctctaagatgactggtattctatctgaaatgcagagattaagccaaatacctgatgtattgtgaaagccactgattttaagaatggagagaaagggattttttactgcatccctctgtatgaatatgaaatcagagaccagggcatgatgttgctaggattagagcctctcagtctggcctcttcacccaagtgcaagaactcagtctcttactgttcaaagaatcttaacagttgaattatggagggaaattcccttttgccccaagcatttctatatttaaagcaatatcccaggagaatatgttagacttaggatgataccttcagccacttgaagaagaaatagaaggcgctcattccaatatagtctttatttcccattcagatacaggttgagcatccctaatctgaacagttaaaacccccaaatgccccaaaatccaaaccttcctgaacgctatgacaccatgagtggaaaattccacacctaacaaacacatttgctttcttatggttcaatgtacacaaactgttttatatagaaaatgatttcaaatatcataaaattaccttcaggctatgtgtataaagtatatatgagccataaatgaattttgtgtttagactttgtgtccatccccaagatctctcattttatatatatatatatatatatatatatatatatatatatatatatatacacacacacacacatacacaaatattccaggatacaaaaaaaaacatttaaaaatccgagacccagaacacttctggtcccaagcatttcagataagggatatcaatctgtactaccaataaggatttcgtaattcccctaactgcaaatgtcctcttcatttgttctttatgagaaaacccgggtagtgccagcacctggatacagtatttacaccctgcagaccctaaagatttcagattcagttagcaaaccttgatgaagcacctgctggacactgagggacccaaagctcaatcagccataatccctgctttcagagtttatattgtacctgcctaatccacccggcgtgactcatttcaacactaagtactaggggtgttgtcaggagacaaatctgaagtcaggagaggaaaatgcaaaggagccctgccgtgtgatggatgtgcattctcacttgggtcttgaagttctcattcctacatctcaagctagccaggcagtctcctctctatcagaagaaagcactggtaattggctagactggctatgttgaaggtaacatgaactctaagatcttgacccagggcgacttggttttgcttaaggtggcatcaccaatgttccaaatcctttagggagatgagggtatccccacagaaaaagaggaataatagaccaatggattttctcctttcaccagtatgtttggaaccctctgatccaatgtcttttgatactgatctcttgtccaaatgagaatgtcgctttagctgaaattcaaatggctgtgacaatttaccgaaatgatgaagtaaccaccattcccacctttcactgcctaggctccaagtctgaatacatttttgaaataggaactcccttttgcaaaaaagaaacctgggtgtcagggaggtgaagtgacttgccctaggagcagacagcatgccaagaatggaattaggctcaggatccagcctgggctcaccctgtgtggctcattcccacccaggaaactgaagataaaagatttgggaaaacacaccaagaaaaaggggcagttttctttgcccaagcatttggtgctagttagaggctgttcactctctcctgctcctcttcggagtagaaataaaggctgtgacacaaggaagccagtggggtgggagggaggcaccataatccctccctaaaacccacagaagactaacctgatactcttttgacccaactgcatcaacactaaacagctgcagaccccctgaatctttcacacatgccaagtgaacattcttgatgatttctctttgtgaccgcaaccacctgcaaaccagaacgactctagaatttccttccccgcccccctttttgtttagtttctaatctcttgtttatgaggtgtggggtttataagggactgaatcaaatgaatgtaacaaaaaagaaaaaaaaaacaaaaaaaaatgccttttctcagggccagtgagttgcaaataatttttaaagaaaagcctataattacatcatctcaataaattttttataaaaaaaaaaaaa

SEQ ID NO: 270 - DNA, 4835 bp, Homo sapiens
ccttgccaagtaacagctttgctgtccaacatcgtgtgctgcttcgcgagaaagtcacattcggaccctttggctagattatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagtattttt

SEQ ID NO: 271 - DNA, 1858 bp, Homo sapiens
ctctgcctgggtgtctccctctctcagtgtgtgtgtctctctgtctgttttcacactctcctccccaatcgagcgaggcccacacctggcgcatcactgccgagccattagctgcgggtttcctttcatcttcgctgtggcagacgtttctatttatccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtgaccctagctcccaccgccaccgccgcggtcgcggtccagaccgcgctccagcagctccgcgccctcccaggcacccggcctttctttctccctcttgcaaccaagatccgtccggccgctggagacccagggagccggggttaggaactcacttggggctttcccctcccccaccggagagccccgggatggagagccgaaaggacatggttgtgtttctggatgggggtcagcttggcactctggttggcaagagagtctcaaatttgtccgaagccgtgggcagcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgaggtgagctgcaccccggactgcgccaccgggaacgccgagtaccagcacagcaaagggtccggctccgaggcgctggtcggcagtccgaacggagggagcgagacccccaagagcaacggcggcagtggtgggggcggctcgcaaggcaccctggcgtgcagcgccagtgaccagatgcgtcgttaccgcaccgccttcacccgagagcagattgcgcggctggagaaggaattctaccgggagaactacgtatccaggccgcggagatgtgagctggcggccgccctaaacctgccggaaaccaccatcaaggtgtggttccagaaccggcgcatgaaggacaagcggcagcgcctggccatgacgtggccgcacccggcggaccccgccttctacacttacatgatgagccatgcggcggccgcgggcggcctgccctaccccttcccatcgcacctgcccctgccctactactcgccggtgggcctgggcgccgcatccgccgcctccgccgccgcctcgcccttcagcggctcgctgcgcccgctcgacacgttccgcgtgctgtcgcagccctacccgcggcccgaactgctgtgcgccttccgccacccgccgctctaccccgggcccgcgcacggactgggcgcctctgccggcggcccctgctcctgcctcgcctgtcacagcggcccggccaacgggctggcgccccgggctgccgccgcctcggacttcacctgtgcctccacctcccgctcggactccttcctcaccttcgcgccctcggtgctcagcaaggcctcctccgtcgcgctggaccagagggaggaggtgcccctcactagataaggggccgccggctggctgccggctccatgacgcccgtggggtcaccccccggccccgggactcagccagcctcgctcctcgctcctcgctcctcgcccctaggacgccaagggggaaaggagagggcggaaaaggaccagcgggatcc

SEQ ID NO: 272 - DNA, 356 bp, Homo sapiens
cagctgggagaccacagggtactcggggttgggcttggtcggagagaagtagaccaagcccattcagaggtccggaaggggcagaggtcctgggacacgagctgggaacacggggcgctccctaacccaggctgcggcgcgtctctccccgcaggtgtggttccagaaccggcgcatgaaggacaagcggcagcgcctggccatgtcctggccgcacccagccgaccccagcttctacacctacatgatgacgcacgcggccgccaccggaagcctgccctaccccttccactcgcacgtgccgctgcactactacccgcacgtgggcgtcacggcggcggcggccgcggctgcag

SEQ ID NO: 273 - DNA, 4341 bp, Homo sapiens
aaaccaataaggttaggacaagagaatagctgtggtttgcgttgcaaaaaccaaaaaaaaaaaaaaaaaaaaaaaaagaaagccccgaggctccatgggcagacctacaaggctgcgcaaacaaatcgagggatgagattctgctgtttctttgtctagggttctcagatgctatctgccgctgctgtttggtggggaaggagcgctgggcgcaaagctgttaccaaacagaacggtgggagctgatggctccgagtttggggcgaggtagaaactctccagtgccacttccgactttaagccttcctgttgccgtccactgtggcgggtttcttcctggggaacacgttttcgctcagtcgctcggcagcccgagcctgcggcagcggccaggcgcctgccccctgcgccgagctttcccctgcagaggcgctccactcccagaagcgccgcggctgcaccagagcgcctgagagcccccgcgcgtacccatccaggagcaaaactatgtcaggaatggaggtttgctaacccagaaaattcgaaggaacacattaaactggtggatgcagcagatgtaagcgctgtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaaaaaaaaaaaaaaaaa

SEQ ID NO: 274 - DNA, 3096 bp, Homo sapiens
cgggcgcccagagggcaaatgaggggcggcggggtggcgggtcggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactgatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgcctt

SEQ ID NO: 275 - DNA, 4456 bp, Homo sapiens
cgccgccgcgcgagggagcgaccagggcagcgcgacgcgggcagagcgagcgccgcggaccccggaggcgagcggccgagggagcccagtcccaacttcgggccccggccccgcgcgccccggcccggccccgcgaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccggtggccccgccggccgccacgcagaacggccactacggccgcggcggagaggaggaggccgcctcgctgtcggaggcggcccccgagccgggcgactctccgggcttcctgtcgggagcggccgagggcgaggacggggacgggcccgacgtggacgggctggcggccagcacgctgctgcagcagatgatgtcatcggtgggccgggcgggggccgcggcgggggacagcgacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaaaaaatcacccaccacccccccaaaaacacaaaaaaagaaaatctatctatatacagatatctatatctatatatatatatacagatatatatatatgacgcgtcacagaatctagggtagcgctttctcagatttccctcctttctgacgtttttctccctccgcaggggccccggccctccctggctccccttccccccaccaccccatcgctgggtttcggggcttggtttggggttttttgtaggacacaaggaatccgagaccccgcacagccccctgggcacccggcatggggcctggggcccgatccgaggccctgggctggggggagggtagacgtgggggcgctggggggggactggggtgggcttttaatttcctcccctcgctggtttctatgagtctttcagacaagaccttaaatgatttctgtctgctctgagcggacgttaaaatgggcccccgtcccccgacccgcaccctccttcctcagggcacttactaagggaggggtctccctctccatctccccagtggcctccccgcctccaaccctgcctgcggcctccccccgtcgcccaccccacgtctcctggccactgagacacaaacctatttatttctaggcctggagaaaggagatcggactggggttcccggtggggcgccaggatggctcctgggggtgctcctgccgccttccttcacggcacttacaaccggcgggacccccagggaccacccctcagggcgcccccccacccccgcccggtccacctagacccccacgtttggagattcaaaacttctgtcttcgtcctctcccccgagccccctctcccaaatttttaaagcactttttagatttttttttctctttcctccttaaaaacaaaatttatatatagatatatatatatatataaataatatacttttcctcagaggagcaggcaacagtgtgggataaacagagtcacgatcagaggaaccccagggtctggtgatggcagggatggggggagagagagaaaatccacaaattccaatgtcacaaaagcaataaaacaaactagaaaaaaaaaaggttttacaaaatgaaaggaaggaaaaaaaaaaaggcaaccaaccacattagaagtcttggcactttgtaacggaacgggtactacactttatcttaattcttaatttaaaaacatgtttacaagttacaaccaacttctatgaaaagttgaaaagacaaaaaaaaaaaaaaaaagcgagcgagagagagagcgagagagagagcgagagcagaagaaattcctaaaagtcgatttatttttgtacaaaataataaaaaaaaaaacccaccacaaacgtagaatccacttctgttccccaaaaagcgagaaggggggttcaggaggaagccatcgcaggggacctgggagacgccccgaggtgtttgtgcttcacccccagacgtcagcctcgaaggcaggactgtggggtgttcgtgctgtgttccccccgctccccctttctgtccccttttttggttctgacgtgaagaggtcttagcgcccgcttctgtccacggggtctctccttcctcctccctagctcagggatgggccttccagccggagcaccccgatccccatccggcaccccccaatcccccaacacgcctgtccctcccgcatggccaccaaggagctggaccttggatgcgcctaccctgctgaggtgggtgacaggggccccccacctccagggccttagaaccaccgcccctctccccaccccaggcacccctctttttactcaaaggcactgactgtaatccagggggactgggacctgcctccccccaacctctggctcccacaaggcccggtgttgaccgagccacaggccacggacaggggccggggttggggagactatgtcgccagatgccaggacgccctcaccccgtttgcatatgcaatgctagcatgggaccccgaaaatagacgctctgctgcactgagacttcttgtcaatgcccaaccggcgggggggtgtctccctgcccccgacccccccatacccccttctctgtgacacacacatcttctcgtctctttttctttcattgttaaagggaagctttttaagaaggcaattttcatattgtttctacgggatggttttggttcccttcccttcccacccccccttaagcctgtcagccccctccaaatgtctcaggatcccccctctcccctggggctgggtgacagcaccccggctgcgttcacaccccagtgtcacagggcgagctgttctggagagaaaaccatctgtcgtggctgagcggggagcttgaacacccaggccagggacacccctccccagctcccagagaggccccctgaggggtgagccctctttccaccttcccctatccatgcaccccctcgcaataaaaccaactctaaaatcaaaaaaaaaaaaaaaa

SEQ ID NO: 276 - DNA, 2007 bp, Homo sapiens
acagcagggattttgacaacaacaccccgctacacatagcagcccagaacaactgcccggccatcatgaatgccctgatcgaagcaggggcccacatggacgccaccaatgccttcaagaagacggcctacgagctgctggacgagaagctgctggccaggggtaccatgcagcccttcaactacgtgaccctgcagtgccttgcggcccgggccctggataagaacaagatcccttacaagggcttcatcccggaagatctggaggcgttcatcgaactgcactgacctgcccagaacgcctgcaccctcacctctcccctctcctgctgagatgggggaaatccggctgcggcatagcagatgctcgttcttgcctccttcaggcaccaatcaggagaagggttctgcctcccatcccctctacctgcagacagggtcggaggtgttagcgagcctttggtgctagaagcctgcggggtcatgtgctaagaggacagtctttctccgggagcccgctcactcattctgagttaggaaaagacacaagaccttccccacatcctgtctgcctgggttagggaggcctttgccttgttacctagaggcggagggactgaagccattgcgttccttccctgctagaaacacaggaagaagttgaggacggtctgccttttctcgtccctttacctggccagataactccagccgctgaatacagtgttaggactgggggctcctgagatgagagtttgagattcagggaatgagaccacctctcatttcttccagcatgatcgcgccctgctcccgtgccaccgtagtccctggcagacaggcagggctctgcccagggcagcctgccacttgcatagctttcggttggtttggtgttctgtttatttaataagtgggcaggttgcaagcgttgcacagaaattctgagattttactgcctttttttttttttttttaagaaagttgtttgttggactccataagtgaatttcaagcagtgaggattttgtggtgcctgagatggccgagggcacagggagtgagctgtatgtgtgaggaatttggtgagcgagataaaagtccacggtgtcaacccctaaaacatgggtgaccgtacatttttatacatctccactctacggccttttacaggctttccgattttacaggcctttccaagtttccattctccttagagagagaactgtgcttccaaacagaaatcaggagtgaccacaaagcctgaaaacactttgccacccagcaaagaactggcacaattggtttgggtctgcattgccatagtgcccgagttaaaactgcaggccactctgccttgcaaacctcacgtggcctctgatttcattgtgggtgcatccacaggtggcccgagctgttctttcagctgctccaaggattgagacccaagtcatcatgaaaaaggcccaagtacagtcttaatgcgataaatccactagctaagacgtcgagtgccaagaccagccttccagccgaggtttggacaaagtctcaggttcccgtgactcagggtaaggtgctggggctgccagaggacctgccccagcaagattttttgtcaagagcgagactccatcagcccaggcagacgggagcaggttcttggccagcgtagacagcagcaaacagcagcagggaagccattctcactgcatcctccctgcagtagccacggccaggcccttaggaggagcagtgaccgggggtgtccagaaatatcctgtccctggatggaaactaggtctcgtttggattttttttttttttttgccgtgttaggaaattatttattaatttacaagacaggttttaactcagccgaggtgggaaatggtgtccctgtccctcccaaagcacagagcacagaaatgaggccgtttacatggcgagtctccgtgctggtgtttaagtcattaaaaagatactcaaagaaaaaaaaaaaaaaaaa

SEQ ID NO: 277 - DNA, 2095 bp, Homo sapiens
cttttaaagtttgaggggcggtggtggcggcggccggcaggcgcgggggaacacaggggccgctacgggagccgcgccgccgcccatgtcattccacttcaagtgacttcatgtgatgtcagctgaatgtaaaagacagtgatctcacgcggaggggaagatgtttgccatcaaaatgtgacagaagagacacgctgcatggctcggaacgcatctccttggtggtgggggaaagagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggaaaagccacataaatgcaaccagtgcggcaaagcgttcaaccgcagctccacgctcaacacgcatatccgcatccacgcgggctacaagcccttcgtctgcgaattttgcggcaaaggctttcaccaaaaagggaactacaagaaccacaagctgacccacagcggcgagaagcagtacaaatgtaccatctgcaacaaggccttccaccaggtctacaacctaaccttccatatgcacacccacaacgacaagaagcctttcacgtgcgccacttgcggcaaagggttttgcagaaactttgacttaaagaaacatgtgcgcaaactccacgacagcgtgggccctgctgccccctccgcaaaggacctgactaggacagtgcagagctgagagctactgccttgcccttccttccctccctgtaccacctgaaaacagatcacacatataaacttatttctaaaattaaaagaaaaaaaaactatagcagagaggctaaaatctatttatcgaaaccagcatatttttggaaagctaaatgtttcctcgatgactggcagcaaactcgtggcccccacctttgtatattcaggaaacttatttaaatccagtgcgccgaaacgtatttaattccaggcctccgcttctcctggggcagccagttttaaccccagcctgtcaccgtgagcgccccagaagagcgcggcgcccctagccatctttatacagccatgtaaatcctcctgtacaagcgaacacggaatatatacatatataactcaataaacagaatcattagtgaaaaaaaaa

SEQ ID NO: 278 - DNA, 2524 bp, Homo sapiens
cccgcccctggctagccgcgcccgcccccgcgctcctgcttcctcccctctttccctccccgcctcccaggcgcgcacccctcccctcgcgcccctcccgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgcaaaaaaaaaaaaaaaaaa

SEQ ID NO: 279 - DNA, 1735 bp, Homo sapiens
agggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaaaaaaaaaaaaaaaaaaaaaaaaaaaaaaaaa

SEQ ID NO: 280 - DNA, 2135 bp, Homo sapiens
aggaagcaggcagagcggggaaggctgagtccacactgcaagtccagagagcagggaactaccttgagtattctactcaaacttatgtctcagagttccccaatttcccaagaagggagagatagaggccacaatccagggggccatctcttaaggtaccaataattttgcagcccagtaggagtcatgtacacggtataagacttggaggaaatgcagggacccttctgttttctcctgcaaagttgaaaaagctgcatgcagttggaagggatcttcagatggtgctggtgactttctgttccttttggagttgacatgcatgtggattggaggaaaaataatcaacatatattctcctttcgtactgtttaaatcacaggaagaagcggctttaagacaaagatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggttcccgcaaaatggaatttaagggaaactactggcatgaaacctgttttgtgtgtgagaattgccgacaacctatagggacaaagcctttgatctccaaagagagtggcaattattgtgtgccatgttttgagaaggagtttgctcactactgcaacttttgtaagaaggtgataacttcaggtgggataacattttgtgaccagctatggcataaagagtgttttctgtgtagtggctgtaggaaagatctctgtgaagaacagttcatgtccagagacgactatccattctgcgtggactgctacaaccatctttatgccaacaagtgtgtagcctgttccaaacccattagtggtctcacaggtgccaagtttatctgctttcaagacagccagtggcatagcgaatgctttaactgcgggaaatgctctgtctccttggtgggtaaaggcttcctgacccagaacaaggaaatcttctgccaaaaatgtggctccggaatggacactgacatctaggagacagtccttgcccacctaaaatccattttgccttcgttgtcactaaagccagaactcagttgcggtcttatttttgacttaagttttagaaaatattcatgtagtttagagtggaaaagtttttgcacacattttgatcgaactatattctaagcacacaaaaagcacagtagaacagaaatgaatatatgctaaatcacaaagacaactctccttgcaaaatactgcactctgctgttagaagcagaggaaaatatctcttcataatcaaatatatgacatatacctaggagctgtggatgtaattactgaagaatgaggtttttcatacctgaagagtaaaagaaaaactaagagatcaaactgagaggtatacatgaggctagtgtttgcattcctggttatatgtaatgtgataaattagctatgaatggtaaaagaacaaaactgatcagagtaaattcattagcaattatcacatttaagaattgttatcatttaaaaatcatcctttttttcacacatactgactgtagaattaaaaaacaaagctacaatttgccctcatacacactgcttccacagcttgctagttctgtgtttactcaatggaatatgagaactgaggacattatggctctcataatctgcataggtataaagaggatcatttctacctagggatagccaaagcatgggtttcaacacgttttgtattaaatatattttcaaagtccacagtgatttttctaaacgcttacagattccatgaaataaaagtctattctttcaagtggagctaaccaggataatctttgtccccaaaggcaaacctttaaaataaatagatcattaaatctt

SEQ ID NO: 281 - DNA, 5499 bp, Homo sapiens
tctgcccgccttctggctccccgggagcccagactggtcggagcccgagcggtggcagcgcggggagccccacgcgccgaagggagcggacccgacaggacggccctagaggaggtgctgccgccacagtagcagggaccggagtctcgagccgcggcctcccggaccgtgctgcccaggccagctcagggacagccgggagtacgaaagccccaccctctggggcaccccgggagcggaggcgggagcggggacgcgagcaacctctccccctgttggagagaaaagacccttaccactcgggtgagggaaagaagagacccctggaggggacgcctctctcctgcctagaggcgaggaagacccctgtactggccggggaggagacccccagaagtggaaagaagggagctttccgtagggaagcagagtgagaccaccctagcgcgcccccgcccctccaaacacacactctcaacagttcaggactttggaggcaaagagagacggggctgtgcctgtggagtaggcaccctcggcccaccactattcacaggagacaggagtccttacgttcagaagccactccagggaaagaagaggaatcggctttcagccttctggagaggggaagacctccccctcaacttcctcgtgcctagacagtggaacggggtggagcccctccgctcctatctccagcagacagaaagagccctccacctcagaaagatccagtttgggggggaggggaactcccccaagggggaggagacaactcctggttgggagaggctcctcccctcctcccccgggtaacaagcagggtgtggggggtgtgccaccttccccaagtaggacctccttctcctccccctccccctcctccaaccttgactcctcatcctcaggggacccagttcccctcaccaacttgggaggctcagcctcgtccaggaagagccactgaggatgagagccgtcacctgcctctgaagaggggaatccctccaaccccaaactccagtaccaggtggttccctccctttgccggaggaaccttggagacagaacccagaagtaccatggcttctgacctagagagtagcctcacctccatagactggctcccccagctgaccctccgagctaccattgagaagcttggaagtgcctcccaggctgggcctcccgggagcagccgcaagtgttcaccagggtcacccacagatcctaatgccaccctgagcaaagacgaggcagcagtgcaccaggacggcaagccacgatacagctatgccactctcatcacctatgccatcaactcctctccagccaagaagatgaccctcagcgagatttaccgctggatctgtgataacttcccctattacaagaatgctggcattggttggaagaattcaatacggcacaacctttctctcaacaagtgtttccggaaggtgcccagacctcgggatgaccctgggaagggttcctattggacaattgacacctgccctgacatttcccgaaagagaagacaccctccagatgatgatctgtcccaagactcaccagaacaggaggcaagcaagagcccacggggaggcgttgcagggagtggagaagcctcactgcctcctgaggggaatccgcagatgtcacttcagagccccacatctatagccagctacagccagggcacaggatctgtggatggtggagcagtggcagcaggggcttcaggccgagaaagtgctgagggtccccctcccctctataacaccaaccatgactttaaattctcctactcagagatcaactttcaggatctaagctggtccttccgcaacctctataagtccatgctggagaagtcctcttcctcctctcagcacggcttttcttctctcctgggggacatcccaccctcgaacaactactacatgtatcagcagcagcagccaccgccacctcaacagcagcagcagcagcagcagccgccacagccacctccccagcagtcccagccacagcagcagcaggcacctgcccagggcccctcagctgtagggggtgctcctccactgcacaccccaagcacagatggttgtaccccaccagggggaaagcaagctggggcggaaggctatgggcctccccctgtaatggccatgcatccacccccgctgcagcatggaggctaccaccctcatcagcaccatccccactcccaccctgcccagcagccaccacctccacagccacaggcacaaggccaggctcccatcaacaacactggctttgcctttccttctgactggtgctctaatattgactctttaaaggaaagcttcaagatggtgaatcggctcaattggtccagcattgagcagtcacaattctcagaactgatggagagtctacgacaggcagagcagaagaactggaccctcgaccagcatcacattgccaatctgtgtgactccctcaaccacttccttactcagactggtcacgtgccccctcaagggggtacccaccgcccaccagcccctgcccgtattgctgactcctgtgccctcaccagtggcaaacaggagtcagccatgagccaagtgaactcttatgggcacccacaagctccccacctctaccctggcccatcaccaatgtacccaatccccacccaggactcagcaggatacaatcgcccagcacaccatatggtccctcggccatcagtgccacctcctggtgccaatgaggagatccctgatgacttcgactgggacttgatcacttagtgcatcacagagtgtggacatcagcccagggccgcgtggtgaaatctggcagtggggaaagagcaaccccagcccgtcccttccccccgtctgtatatagacatatatcctctttttgttctttctctgtcagagaagccactgcaagatgctgccgaagataaccctctctttcctgcctcattcttctctcttccttcctgttttttcctagttcttttattattattcttatattattattattattattggttatatactgtccatagtctcctgtccctacatcatggatcatgtccaccttttgctaatttaaaatcatcaggctggaagatgaagccatgatagctacagagaaaggttttagactccagtttacctttctcttggagaaactcaatgctaatcccaccttttggccctaaattgttttttgttcccatcagtttcaggccaggactggagaggccacattaccaagtagaaagggtctgaaacattacttggcagccaagaatttggaggttttaaaatggtgctaattctgtcctctgaggtcttccttgtccctttataccttcaatccttacttctgccagtctgtatttcctatcaagggtgaaagtgatgatggtggtgcaggagggtgacaataaaatcctagtggaattggagaccattggaagggatggaatataagtcagtgtgaaactgagtatacactgccatgttacatcagtgtccattggcttgttttgagcctgttctctaagaagataggattggttttagcccaaactctgcttctatggtagggcatgaggacaactattcagcatggttttagcttcttggagatgattccaacttaactattttggctttttaaacataattttctctgaaaattaattgtggctcttatttgcatttacgaatgatcttcccatccctttttcccattcagcaaatattagtttgtcctcctttaattgtttgcccaaatcttccacccatcttttttcttccctcattttctgggattctcaagaaagaaaaagtaacccattatcactctgagtttcgtcgtgccctgagacatgatgggaatctcattcccacctctcatagcagagccaaacctttagtgttggtggtaggaggatggggagaggaaaaaagagctggcaaagaaatggatagggaatattttagttctttaaatatataggcagatgcttctcttggaatccagatcatctggctgaagcttttgcaagtaggctttgaggggtgaaggagattggtggaggagagtaaataatctagaggcaagagttcagtgagggccaagggggacccccagaaaaaggtatggagctaactcatctcttttacaaggggtggccatgacttactgttgcaaagtactcagtgtatatttaatgttgattgttgaattttagttacgagagggaagaacaattttacttctgtccttatttcacttgctgaaaagctgtgggacaaaatgtatggaatagacaaggccactttctttgtgatttctgcttttcatgcatattattttatttacccataatttccaagaggtttggcgttccgctctcctgcttttttctttcatccacccctttcctttttttggaagggggttatatatgagagttcattgaagaagtccagtgaggctgaagtaaaggggcaagatagggcagttaactaaagagcactttatttctttgaagcctttctaagaaagaaatgggggtgcgagtggcttgaatctcccatgatgttggagggcacttagtggggttgaagtatgacataatatttcccattggggaaaggagaatttctcttagagggtggcaaaatgcctttgcccagtgtccctattttaggcatcttttccttccttattccttccagtcagggtgtgtcctatacaaaacttcccatcagttctcctcaatattccccatttgtaaatgatcacttctcttttctaaacccttttcctgttcagatccatacaggatttgcaagggtaggatcatacatgcaaatgccccttgttcatctgtgtcttctgcaaactagtctcatgaagaattctggcgtgcagccagggtagctgaagtttgggtctgggactggagattggccattaggcctcctgagattccagctcccttccaccaagcccagtcttgctacgtggcacagggcaaacctgactccctttgggcctcagtttcccctccccttcatgaaatgaaaagaatactactttttcttgttggtctagcattgctggacacaaagtgtagtcattattgttgtattgggtgatgtgtgcaaaactgcagaagctcactgcctataagaggaaataagagagaaagtggaggagagggacaaaaggagtaattatttggtatagatccacccatcccaacctttctctcctcagtccctgctcctcatgtttctggtttggtgagtcctttgtgccaccacccataatgctttgcattgctgcatcctgggaagggggtatatggtctcacaagttgttgtcattgtttttttgcatgctttcttaataaaaaaaaaaaaagaatgtttacagttttatcttaaaaaaaaaaaaaaaaaa

SEQ ID NO: 282 - DNA, 333 bp, Homo sapiens
cctggcgcccccacaactgagccaaccaagcctccctacagctacatcgcccttattgctatggccatccagagctcaccggggcagcgggccaccctcagtggcatctaccgctacatcatgggccgattcgccttctaccgccacaaccggcccggctggcagaacagcatccgccacaatctgtcactcaacgagtgctttgtcaaggtgccccgcgatgaccgcaagccaggcaagggcagctactggacgctggaccctgactgccacgacatgtttgagcacggcagcttcctacgccgccgccgccgcttcacccggcagacaggt

SEQ ID NO: 283 - DNA, 3993 bp, Homo sapiens
agaagagagaggagagctcgaggcgagagagagagagagagagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattctaaaaaaaaaaaaaaa

SEQ ID NO: 284 - DNA, 13746 bp, Homo sapiens
cgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaaggtagctgaatatacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggagatgacccattcctggcctactcctctcacttccatgcatactgctggacactctgagcagagcaccttttccatcccaggacaggaatcgcagcatctgaccccaggattcaccttacaaaagtggaatgacccaaccaccagagcttctacaaagtcagtgtctttcaaatcgatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaagcagattagctgctactacttttaaaagacttaaggtcgggatgcctttttttccatgtaaggaaatgaaaagaccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgtggggagggcagaaagggggtgggggtgggggcgggggggtggggggtggggaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagaaatcctctttgggatcagaagatacctaaaattctccccttttgcccacttggttagatgagtgatatattctttggatcctgcaaagaagagattggtttattttcttttctggtggtggtagtggttgtatctgtggctgtgatggttgttgttacttgtctctctctctctctggctctggcttttgctttcctgctagtgttctttctctttccaaacaaatagttaaattaaatgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacacacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcaactggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 285 - DNA, 2158 bp, Homo sapiens
attcataaaacgcttgttataaaagcagtggctgcggcgcctcgtactccaaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaccaa

SEQ ID NO: 286 - DNA, 3776 bp, Homo sapiens
cattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgca

SEQ ID NO: 287 - DNA, 1668 bp, Homo sapiens
acgggccaaggcggcgcgtctcgggggtggagcctggaggtgaccgcgccgctgcaacgcccccaccccccgcggtcgcagtggttcagcccgagaacttttcattcataaaaagaaaagactccgcacggcgcgggtgagtcagaacccagcagccgtgtaccccgcagagccgccagccccgggcatgttccgagacttcggggaacccggcccgagctccgggaacggcggcgggtacggcggccccgcgcagcccccggccgcagcgcaggcagcccagcagaagttccacctggtgccaagcatcaacaccatgagtggcagtcaggagctgcagtggatggtacagcctcatttcctggggcccagcagttaccccaggcctctgacctaccctcagtacagccccccacaaccccggccaggagtcatccgggccctggggccgcctccaggggtacgtcgaaggccttgtgaacagatcagcccggaggaagaggagcgccgccgagtaaggcgcgagcggaacaagctggctgcggccaagtgcaggaaccggaggaaggaactgaccgacttcctgcaggcggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacccccttggctctccaaccctcctcgctttgtgaggcgcctgagccctactccctgcagatgccaccctagccaatgtctcctccccttcccccaccggtccagctggcctggacagtatcccacatccaactccagcaacttcttctccatccctctaatgagactgaccatattgtgcttcacagtagagccagcttggggccaccaaagctgcccactgtttctcttgagctggcctctctagcacaatttgcactaaatcagagacaaaatatttcccatttgtgccagaggaatcctggcagcccagagactttgtagatccttagaggtcctctggagccctaaccccttccagatcactgccacactctccatcaccctcttcctgtgatccacccaaccctatctcctgacagaaggtgccactttacccacctagaacactaactcaccagccccactgccagcagcagcaggtgattggaccaggccattctgccgccccctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtg

SEQ ID NO: 288 - DNA, 4015 bp, Homo sapiens
cgaacgagcggcgctcggcggggacagaaagagggagagagagagagagagagagggagaggcgcggccgggcgaggcgggcccgtccgggagcgggctccggggaaggggtgcgggtctgggcgccggagcggggagcggggccgcgtccctctcagcgccagctctacttgagccccacgagccgctgtccccctggcgcgctcggggccgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaaaaaaaaaaaaaaaaaaaaaaaaaa

SEQ ID NO: 289 - DNA, 3124 bp, Homo sapiens
taagatccacatcagctcaactgcacttgcctcgcagaggcagcccgctcacttcccgcggaggcgctccccggcgccgcgctccgcggcagccgcctgcccccggcgctgcccccgcccgccgcgccgccgccgccgccgcgcacgccgcgccccgcagctctgggcttcctcttcgcccgggtggcgttgggcccgcgcgggcgctcgggtgactgcagctgctcagctcccctcccccgccccgcgccgcgcggccgcccgtcgcttcgcacagggctggatggttgtattgggcagggtggctccaggatgttaggaactgtgaagatggaagggcatgaaaccagcgactggaacagctactacgcagacacgcaggaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccgccatgaacccgtgcatgagccccatggcgtacgcgccgtccaacctgggccgcagccgcgcgggcggcggcggcgacgccaagacgttcaagcgcagctacccgcacgccaagccgccctactcgtacatctcgctcatcaccatggccatccagcaggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggcccccgggcccgccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgcgaagtttaatgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccgaaagttacaaggaccccaacccctttgtcctctctacccacagatggccctgggaatcaattcctcaggaattgccctcaagaactctgcttcttgctttgcagagtgccatggtcatgtcattctgaggtcacataacacataaaattagtttctatgagtgtataccatttaaagaatttttttttcagtaaaagggaatattacaatgttggaggagagataagttatagggagctggatttcaaaacgtggtccaagattcaaaaatcctattgatagtggccattttaatcattgccatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaacaaaaaaaaaaaaaaaa

SEQ ID NO: 290 - DNA, 2428 bp, Homo sapiens
cccgcccacttccaactaccgcctccggcctgcccagggagagagagggagtggagcccagggagagggagcgcgagagagggagggaggaggggacggtgctttggctgacttttttttaaaagagggtgggggtggggggtgattgctggtcgtttgttgtggctgttaaattttaaactgccatgcactcggcttccagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagacataaaaaa

SEQ ID NO: 291 - DNA, 3575 bp, Homo sapiens
gaattcctagactcccgagtcttggaatcttagaattacagggtcgcaggatcgcaggatcgcattctttagatttatggaatcacgttagccccgtcgtccagaatttaaaatctagatatctgaatctcagaatcttgaaagttactgagagccacgaaatcccgtattaaaaggtgcctataatataatccagttaaaaattttaaaatttgaagtttttcctcctttgtaaaaacgaaacagacgaaatctgggcgttttgcttctccattacttgggaagaaggaaaccaggagttttgtttagcgagtgtaaagcccctctcccttcgttcgaccaaccctctaccgcagaaggttgtcaagcaaagcctttgagcgtttccacacaccgggtcgacggagcaaggatctgggctttgctcgctcttccgaagcagctgccaacgcttggccgggcttagctgccctcagctcaccgccacgaagaacgcgactaaaaccctccaagcatgccacccgttaccggccagaacctctcgtcttgggatctcccacactcacctggcaccaccctcccgctctcacccacagccccgcccgcccccccccccccacaccggaaagctgcgtccgggctggagcactggaacccgcgcccaaggggggaatcctatgcgtcaggggcctcggagatcagcacacgcccaccagctatttaacagagtagaaccctgaggccctgcgaggggacaaggacaggccctggatctcccagtgaatggccagggaacgaacccggcgagaggggcgcgcgcaggatctcaggttaaggaccaagttccggctcagggacagcaggaaaggaactcagaaattggacaccatgaagcaaacgtgtgtcccgactgcccgccccttcccccggagacgcccacccggccaccgttctcttcccactcccccattacccacagccctcactcccctgcggaaggggtgcttggctgcctctgggggcttcagagctaccctggtcccgggggattggaggaggaggttacctctcctgcgtcgttctttcaatccgtgcaccactatccatcaaatagagacagatcctgggcctctcaaagacggatgattgggggtggtgattggcctatccctaaatatctaccacgcaaggactcttgagagatccagaccccggtacagtcgagggacctggggcccaaaaagsggaaagcggctacctcttaccacacagttgggaagcgcagtcctaaaggagacgcaggttggagactccgctaagcggagaagccgcagtggggccatggaaagtcaccttccctttcggttctaggaattactcattcgaaagatggggggactggagtgccgagtggctgtggcagccacgattggggtttggaaaccatcctgaaaggcccggggagccagtctcctggaacttctccctccctattcccacaaaaaccaagcgccctctcggccaattctcaccctctcaggacaaaaaagtgagatgagcccgtcctttcacctgcgatccaagcccttggcagaggcctgaaaagtccgaaaactccgagttcgggcggtgaggtctcccgagccggttcctgaactctccgggcctcagtcgatcggggtgggacccccccccccccgcccatctccaagcgccctccccaccctgacgttgtggggctcctaccgggcgccacagctgctcctacctggggaggtgcgccgggccccaggggggcggacaagtcggggggcgggcagggaaccggttccgccccacgcttcgtgtgcccctttaaggaggggaagccggccgagggaggagccggtccagtgtgtgcaggggagcgcctcgccagcggtccgcggggctggagaccacgccgtggagaggaccagcctcaggtcgccccgcctggggccgggtcccacctcactgccccgcctcgcctctctgcccgtggcgttaccgccaccttgcctcgggggcagggcatgggcggccccgccagatcgcccagcgccagtactaactgcctgctctgccttcgagccccgaagcctcttctgcgcgcgcacaacctaggcagtaatcctaaactagcgggcaccacagaccagctgcagccaccccaacccagggatcacttccggacccctcgaccgcccggcaccagcgcgcaagggacccttcagccggagaccagagtccagtccggtcgcgaggccaccgcgctgcccgcctcgagaagcacaacgcgggctgagccgtcggctagcgggtcactcccgagcctctgtctgcaccgcgccagccccagaccacggacgctgagcctccagcgcgcgccagcctgggccgctgggctctccgggacagcccgtgacgatcccctgagctctccgcagaagggccgagcgtccgttccggggacgccaggcccgcccccgccccccgacagcgtggggatccagagcccgggggtgtgggacgcccgcgccatgactgtcgagagggccgtcgtcgcgaagccggaggtgtggtaccgtgaaggaagagcgggcgcgccagcgccccctgcagcgcggaagccgccctacagctacattcggcgtcatgccatggccatcggcagcccgaggctcacgctgggcggcatctacaagttcatcaccgagggcttccccttctacccggacaaccccaaaaagtggcagaacagcatccgccacaacctcacaatcaacgactgcttcctcaagatcccgcgcgaggccggccgccgccgtaagggcaactactgggcgctcgaccccaacgcggaggacatgttcgagagcggcagcttcctgcgccgccgcaaggcttcaagcgtcggactctccacctacccggcttacatgcaggacgcggcggctgccgccgccgccgccgccgccgccgccatcttcccaggggcggtcccgccgcgcgccccccctaacagggctccgtctattcaggctaagcgcgccgccgtcgctggccgcccgcctcatctactacccgcggagtcgcccggccatttccgcgtcttcggcctggttcctgagcggccgctcaagcaagaattggggcccgcaccgtgggggcccggcggctctttcgccttttcctccgatggcgcccccgctaccaccaacggctaccaaccacgacaggcttcaccgggacccgtccggccaaccccctcctatgcggctgcctacgcgggccccgacggaagtacccccagggagaaggcagtgcgatactttgccgatgctgggcgggtcgggggcaccccttgcccccagcgggcggcagcagtggcgggtggagaccacggtggacttctacggcgcacgtcgcccggccagttcggagcgctggagcctgctacaactggcgggcagctcggagggccagtgcaggcgcctaccatgctcgccatgctgccgcttatcccggtgggatagatcggttcgagggaattc

SEQ ID NO: 292 - DNA, 2000 bp, Homo sapiens
gggaaggggtgagtctgggtctgggaaaaactgatccaaaggcagaaagggaggggcgaaatggaggagggtaccgtgaacagagtaagggggctgggagaggaaattagaggggaggcgctggccagcaggcaaggcctgagccctctcccccggcggtggttgggggggggccgtgtccatataaagcgggtcggcggcccctgcggtcccggagccgcgcgggcaggggctgccgcagccgatggcggggcgcagcgacatggatccgcccgccgcgttctctggcttccctgccctgccagcggtcgcgccgtcggggccgccgccgtcgccgctcgcaggagccgagccagggcgggagccagaggaggcggcggctggccgcggagaggcggcccccacgcccgcgcccggcccggggcggcggcggcggcggcccctgcagcgcgggaagccgccctactcgtacatcgcgctcatcgccatggctctggcgcacgccccgggccgccgcctcacgctggccgccatctaccgcttcatcaccgaacgctttgccttctaccgcgacagcccgcgcaagtggcagaacagcatccgccacaatctcacgctcaacgactgcttcgtcaaggtgccccgcgagccgggcaacccgggcaagggcaactactggacgctggaccccgcggccgcagacatgttcgacaacggcagcttcctgcggcgccgcaagcgcttcaagcgcgccgagctgcccgcgcacgcggccgcggcgccagggccgccgctccccttcccctacgcgccctacgcgcccgcgcccggccccgcgctgctggtgccgccgccttctgccggaccgggcccctcgccgcccgcgcgtctgttcagcgtcgacagcctggtgaacctgcagccggagctagcggggctgggcgcccccgagccgccctgctgcgccgcgcccgacgccgcagccgcagccttcccgccctgcgctgccgccgcctccccgccactctactcgcaggtccccgaccgcctggtactgcccgcgacgcgccccggccccggcccgctgcccgctgagcccctcctggccttggccgggccggcagccgctctcggcccgctcagccctggggaggcctacctgaggcagccgggcttcgcgtcggggctggagcgctacctgtgagcctgcgccgcgcgggcaggcacctgtgcgacctgtgccccggacctgcggcgccgccctcgagcgccccatctctaccccccaccctggcttggagcacaccctgcgcctctcgtcgtggcctcctggactcaaactcctgctacatccttctccgtcccccatccctggggaggctcccaccatctcgccactggacagaagcgtcccctttgacctgccagcctctcatttcttctccctccacttgtgagcgcccccagctttgcggcgccccccaccccagcgctgtctgtgggtcccttgccccggagctgactcgcctccagtgagtccataccccaggtttcctggtgagttccaagcctttggaagccagatctgtgatcccaagccgcctcctccaccgactgtacttcatcaaccttctctcatgtttttccgacactcctgggtcagactcctgggttcatgacttacttgctagcgtcccttcattttcccacaagtttgccccccacctccacttacctgtctgccctcagcttcttcctgggagagagcccccctttcacgtagacacacctggctgccttcttcacgccctgaggacacttcttggagatttcagacaggcagcaccagggctcctgactgaaaggggagttggtgggcctttaggtctgccccatcccctggaaaacttaggacttattgggttattattatttttaattaaagctggtttaattaaaaagaaagaaacttttttctggaaaaaaaaaaaaaaaaaaaa

SEQ ID NO: 293 - DNA, 2579 bp, Homo sapiens
gcagagcagcggcggcagcggcggcggcggcagcagccacccgatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccagcgagttcatgttcgaggagggctcctttcggcggcggccgcgcggcttccgaaggaaatgccaggcgctcaagcccatgtacagcatgatgaacgggctcggcttcaaccacctcccggacacctacggcttccagggctcggccggcggcctctcgtgcccgcccaacagcctggcgctggagggcggcctgggcatgatgaacggccacttgccgggcaacgtggacggcatggccctgcccagccactcggtgccccacctgccttccaacggcggccactcgtacatgggcggctgcggcggcgcggcggccggcgagtacccgcaccacgacagctcggtgcccgcctccccgctgctgcccaccggcgccggtggggtcatggagccgcacgccgtctactcgggctcggcggcggcctggccgccctcggcgtccgcggcgctcaacagcggcgcctcttatatcaagcagcagcccctgtccccctgtaaccccgcggccaaccccctgtccggcagcctctccacgcactccctggagcagccgtatctgcaccagaacagccacaacgccccagccgagctgcaaggcatcccgcggtatcactcgcagtcgcccagcatgtgtgaccgaaaggagtttgtcttctctttcaacgccatggcgtcctcttccatgcactcggccggcgggggctcctactaccaccagcaggtcacctaccaagacatcaagccttgcgtgatgtgaggctgccgccgcaggccctcctggtgcaggcaggcgggtcacagggaccctggaccggcacaagaaactgctttcttctcgaggtataaccgtcggcagaagaaaagggttccacctctccccaaccggagtttttggcaaggagtccccaatgcaaagacacagcgctgcggttggcacctccttcctcactccttcaaaattgttaagaaatgttagtggtgggtctgatctgactgcagccatcggtaaataaaagtttttgatcctgttgaacccgcctgagacggtgctgtgcaggggaaagcccccgcacccacacaggaattctgctgaggtcccccctccttccggccaatggcagaagtgggggaaaatttttagaagaaaagcaaacatgtgagaccaatcattatcaaatacttttattttttggttgagtatttatctttttattttttattttttttttgaaagaatgtcttggaatgcgcaagtctccctttagagccgtcttttgcagggagcgggaagtgacaagagctcagatctccctcccgatctccctccccacctccgaagtctcctccgtggaccacaggtggatctttgtgcgaacaacttgcatttcggaagccactgtccgtctttaaacagaaagtcaaaggagccacgaagcaagcggccgtccgggcgtccgcctccgtccccttccatgttcctcctcttccttcgcttcagcctcttctgttatgttttgtcttgaattttatttagactttttcagtgggtatttttctgtctcccaacctctactgtaaactttctggtccgagaacgagccgaacacagcgcgacgcagggactaggacggcccggtgaccgcgcggattcaggattgcggggacgcagaaaggttaaggcacttttaaaaactatagcaaggctcctgtttatttattctactttctttccctaataatcaaaacaccgcgtaggctcctccgtttatcagtattaatggtgtaactttgttggcaatatttgccgtgtagaattttttttagatatccattgtaaatttgaaacaaagaccgatctgtgtaaaaacaaatttccatatgttttatataaatatatatataatatgaaggactaccctccttttttttttttgtattttggctgctagagtgcagcatttgtgacacgtatttgaaatttgaaatttccttctgcactgtataaaaggaccatttgaggatgttttgccttttgtgtattttttcctaaaaaaagaacaaaaataaaaatgtataacatttgtacatggcctttaaaattgtatcaactagaaataaaattgcatgagtattttaaaaaaaaaaaaaaaaaa

SEQ ID NO: 294 - DNA, 2187 bp, Homo sapiens
agcccgggcggcgggctagggcgctcgcagggcttctgggccgaccccgctccggcgcctccgcttcccgcccggggcccgccctcgcggcccggcctcgctcccgggtcccagatgaccaccgagggcgggccgccgccggccccgctccgccgcgcgtgcagcccggtccccggcgcgctccaggccgccctgatgagcccgccgcccgccgccgccgccgccgccgccgccgccccggagaccacctcctcctcctcgtcgtcgtcctccgcctcctgcgcctcgtcctcgtcctcctccaattcggccagcgccccctcggctgcctgcaagagcgcgggcggcggcggcgcgggcgccgggagcgggggcgccaagaaggcgagctcggggctgcggcggcccgagaagccgccctactcgtacatcgcgctcatcgtcatggccatccagagctcgcccagcaagcgcctgacgctcagcgagatctaccagttcctgcaggcgcgcttccccttcttccgcggcgcctaccagggctggaagaactcggtgcgccacaatctctcgctcaacgagtgcttcatcaagctgcctaagggcctcgggcggcccggcaagggccactactggaccatcgacccggccagcgagttcatgttcgaggagggctcgttccgccgccggccgcgcggcttcaggcggaagtgccaggcgctcaagcccatgtaccaccgcgtggtgagcggcttgggcttcggggcgtcgctgctgccccagggcttcgacttccaggcgcccccgtcggcgccgctcggctgccacagccagggcggctacggcggcctcgacatgatgcccgcgggctacgacgccggcgcgggcgcccccagccacgcgcaccctcaccaccaccaccaccaccacgtcccgcacatgtcgcccaacccgggttccacctacatggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagagctacttgcaccagaacgctcgcgaggacctctcagtgggactgccccgttaccagcatcactctactccagtgtgtgacagaaaagatttcgtcctcaacttcaatgggatttcttctttccatccctcagctagcgggtcgtattatcaccatcaccaccagagcgtctgtcaggatattaagccctgcgtcatgtgaacggaaagaggccaagcgatggccgctctctcctctcccctcctcagagggggcagatagaaactgggacggattcaagtcacatgcacgcggatagcagtaagccacacacctgccacttagccagaatgcccaggatcgcgttggtcactgttatttgcctactgctggaagaaggacaaccgctggcaaggtagcgttccccaatctgaatacctgcaggctcccacatgagggagagggcagactcaggtgggaagatgtgccatgcgtaaggcatcaacgtgtatctgtgggatcttcgttgccttcagtaatcagggtgtgaaaaaagcagacaagttgtgtgtgtgtgtgtgtgtctaagaaaacttgtgtgcttttcaaaaaggcagtgctaagcacaagatttcaagaaagcctcttcttgttgcctagctgagtgggagagtcattttccccagacactacatttggatacaggtgccaaagaacattattaaggaattatttagaaacaatgtgtctagtttaagaaagtggttttcagtattgtgacaatacaacgtttttacaaggttgttttctaccaccatattttaaagatatttttatgaccgtgtatactcacactttgcttgtattttaaaaggaggatatatttgcacttatgtatacttttacagtttgccaaaatattttgttgtaaaattttttttcaataaaatgtatataaca

SEQ ID NO: 295 - DNA, 2600 bp, Homo sapiens
aggggtggttgctgcttttgctacatgacttgccagcgcccgagcctgcggtccaactgcgctgctgccggagcgctcagtgccgccgctgccgcccgcgccccccgcgccccgttcggcacccaccggtcgccgccgcccgccgcgccgctgtcccgctcccgcgccgccgccgccgtttccccccgacgactgggtgatgctggacatgggagataggaaagaggtgaaaatgatccccaagtcctcgttcagcatcaacagcctggtgcccgaggcggtccagaacgacaaccaccacgcgagccacggccaccacaacagccaccacccccagcaccaccaccaccaccaccaccatcaccaccacccgccgccgcccgccccgcaaccgccgccgccgccgcagcagcagcagccgccgccgccgccgcccccggcaccgcagcccccccagacgcggggcgccccggccgccgacgacgacaagggcccccagcagctgctgctcccgccgccgccaccgccaccaccggccgccgccctggacggggctaaagcggacgggctgggcggcaagggcgagccgggcggcgggccgggggagctggcgcccgtcgggccggacgagaaggagaagggcgccggcgccgggggggaggagaagaagggggcgggcgagggcggcaaggacggggaggggggcaaggagggcgagaagaagaacggcaagtacgagaagccgccgttcagctacaacgcgctcatcatgatggccatccggcagagccccgagaagcggctcacgctcaacggcatctacgagttcatcatgaagaacttcccttactaccgcgagaacaagcagggctggcagaactccatccgccacaatctgtccctcaacaagtgcttcgtgaaggtgccgcgccactacgacgacccgggcaagggcaactactggatgctggacccgtcgagcgacgacgtgttcatcggcggcaccacgggcaagctgcggcgccgctccaccacctcgcgggccaagctggccttcaagcgcggtgcgcgcctcacctccaccggcctcaccttcatggaccgcgccggctccctctactggcccatgtcgcccttcctgtccctgcaccacccccgcgccagcagcactttgagttacaacggcaccacgtcggcctaccccagccaccccatgccctacagctccgtgttgactcagaactcgctgggcaacaaccactccttctccaccgccaacggcctgagcgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctgggggactgtctgattatttcacacatcaaaatcaggggtcttcttccaaccctttaatacattaacatccctgggaccagactgtaagtgaacgttttacacacatttgcattgtaaatgataattaaaaaaataagtccaggtattttttattaagcccccccctcccatttctgtacgtttgttcagtctctagggttgtttattattctaacaaggtgtggagtgtcagcgaggtgcaatgtggggagaatacattgtagaatataaggtttggaagtcaaattatagtagaatgtgtatctaaatagtgactgctttgccatttcattcaaacctgacaagtctatctctaagagccgccagatttccatgtgtgcagtattataagttatcatggaactatatggtggacgcagaccttgagaacaacctaaattatggggagaattttaaaatgttaaactgtaatttgtatttaaaaagcattcgtagtaaaggtgcccaagaaattattttggccatttattgttttgtccttttctttaaagaactgtttttttttcttttgtttacttttagaccaaagattgggttctagaaaatgcacttggtatactaagtattaaaacaaacaaaaaggaaagttgtttcagttggcaacactgcccattcaattgaatcagaaggggacaaaattaacgattgccttcagtttgtgttgtgtatattttgatgtatgtggtcactaacaggtcacttttattttttctaaatgtagtgaaatgttaatacctattgtacttataggtaaaccttgcaaatatgtaacctgtgttgcgcaaatgccgcataaatttgagtgattgttaatgttgtcttaaaatttcttgattgtgatactgtggtcatatgcccgtgtttgtcacttacaaaaatgtttactatgaacacacagaaataaaaaataggctaaattcaaaaaaaaaaaaaaaa

SEQ ID NO: 296 - DNA, 2193 bp, Homo sapiens
gttgagtcaatgtgtccccctcttgttcctagggtgcgggcttcatggccttctcctccaggaagctccacctgatcatgtcctgggtggatatccagcccccatagttcagggcctactagcagctgctagatcttgaactccaggagcgccccacgccttgggagcttggcatgggctaaatactcccccatttgttaaatggggtcctgaaacctgaccagggaagacgggataaagtagccatgggtcatcgcagcccctttgaagccgggcctggccacccaaaggcaactcaggggtggagactgaggcctcaggagaagcccccactagaatgctctctgcccctcccttccagattaaccaaaacctgctaattgtggaagccctcggcatgctcccctcccccacagcctcttcctcccttccctcccctcccccttccatccgaatgataaaggccccagcccgcctgccccagcccggcctcaggtcccggccctgccttctacactgccccaccgccctgcaccctccacccggccaggcccctgcccacgctgtctaccgtcccgcatggggccctgcagcggctcccgcctggggcccccagaggcagagtcgccctcccagccccctaagaggaggaagaagaggtacctgcgacatgacaagcccccctacacctacttggccatgatcgccttggtgattcaggccgctccctcccgcagactgaagctggcccagatcatccgtcaggtccaggccgtgttccccttcttcagggaagactacgagggctggaaagactccattcgccacaacctttcctccaaccgatgcttccgcaaggtgcccaaggaccctgcaaagccccaggccaagggcaacttctgggcggtcgacgtgagcctgatcccagctgaggcgctccggctgcagaacaccgccctgtgccggcgctggcagaacggaggtgcgcgtggagccttcgccaaggacctgggcccctacgtgctgcacggccggccataccggccgcccagtcccccgccaccacccagtgagggcttcagcatcaagtccctgctaggagggtccggggagggggcaccctggccggggctagctccacagagcagcccagttcctgcaggcacagggaacagtggggaggaggcggtgcccaccccaccccttccctcttctgagaggcctctgtggcccctctgcccccttcctggccccacgagagtggagggggagactgtgcaggggggagccatcgggccctcaaccctctccccagagcctagggcctggcctctccacttactgcagggcaccgcagttcctgggggacggtccagcgggggacacagggcctccctctgggggcagctgcccacctcctacttgcctatctacactcccaatgtggtaatgcccttggcaccaccacccacctcctgtccccagtgtccgtcaaccagccctgcctactggggggtggcccctgaaacccgagggcccccagggctgctctgcgatctagacgccctcttccaaggggtgccacccaacaaaagcatctacgacgtttgggtcagccaccctcgggacctggcggcccctggcccaggctggctgctctcctggtgcagcctgtgaggctcttaagacaggggccactcctccctcccgctcccacccccaccttgttgacagggagccaaggcgaggcggctgtctgcgaccacagcagcctcgaaacaccaggcagcagccttgctgggagtccacggtgtttattgggccaccccacgcatggccgtggcccagctgggcacaaccctcaccctggtctgtcatgcctgtttttcctacactcagcggcaaagctgcaggagcagggctgagcctggaatagcccttcctagtcccctcttctcagcccactacccatccatcagtcaccagccgtcacctcccctcccgtgctccaggctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgttttaaaaaaaaaaaa

SEQ ID NO: 297 - DNA, 2296 bp, Homo sapiens
gggtgcaggtgccaggcaggtggctccggccagcccagccccagcatgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagaggccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccgggcaaagggaattactggaccctggaccccaactgtgagaaaatgttcgacaatggaaatttccgcaggaaaaggaagagaaaatcagatgtttcctctagcacagcctccttggccttagagaagacagagagcagtctcccggtggacagccccaagaccacggagcctcaggacatcttggatggagcctcaccagggggcaccaccagctccccagagaagcggccctcccctcccccatcaggcgccccttgccttaacagcttcctttcctctatgacagcctatgtgagcggggggagccccacgagccaccccttggtcacaccaggactgagccctgagcccagtgacaagacggggcagaactcactgaccttcaactccttctccccgctcaccaacctcagcaaccacagcggtgggggtgactgggcgaaccccatgcccaccaacatgctcagctatggaggatctgtgctcagccaattcagccctcacttctacaacagtgtcaacaccagtggtgtcctctaccccagggagggcaccgaggtctaggtacagaacagctcctgagccaggtggacatgccagagagaaaagcagtagaggtcctccatgccagccccacggtggtccatgactgcggaactgcccagacataagcaggagcctccgaggaatccaccctctttctagaacactggttaaggcttctgtttatcacacataggcccacacacagactcaccaactttgcaatagaaatactggtgcctgcagagcagcactaacagtggcaggtgctgtactaggctctgtactggccacacttactattgacagtcaccccgtaaggttcacaaaccaccccattgaacagatgaggaactgaggctcaaggaggttaagtaacatttccagggttatataaactagtaaatggcagagctaagagtcaaatccaggtctatgtgatcctcagagattggaggccgggatggagaattggttgagtagccaaggaaggtcagtgtgaaaagcttgctatggcaaatatagcgaaatctctccactgccttctgtccaccaacatttagtgccagcctaggcacaacttgtcctggtccaagtccttattctgcttgccccaacttacctgcagacactccttttgctaccactcaaggaaggaagtcaccagtggccttagtgcaggaaactcagccctggtggccctgcagaacaatgcatctgacatgtgcgatgcatccccatggagagacagcattgctccccagccctccagaaaccttgagcagatccagggatcagtgagaggagtggtgtgtacccctaaatcctcccaccccagcactgcccatctgtaaaatcttgtaaagcccagtttcctgtgtgcatgtcatggaccagtgagctggagatggctgaatcttccaagagaaacaaggttggataagcgcttccttttttttagcccaggagaggtggatgtttgtctgagaaaacaatggcctcaagggaggggccttgggcccaccctcacagggggtctctgtgtgatctcttgggatttctccttgtttttgtgagtacctgggaagtgttgtttgttttcttattttctttttaattaaaaaacaaacaaaca

SEQ ID NO: 298 - DNA, 2666 bp, Homo sapiens
aggagaagcctttggagcggctacttaatgccggtcccggggccgcggtagctcagagaagcgccgtcgggcgggggggcggcaagaggcgctggcagggcccccgagctgggggcagagagccgcagggggtgggagcaacttcttccagaaccttcctctggcccgggctgcgctctgagccaggcaccacatacttattcggaggaggcgcccccggggtcgcgagatggaagcgcgcgtccgggaggccgtgtaacgggagctgcgggactcagcgggccagagagcgcggcgggccacccccggctcagcccgtggatgctgaccgccccctcggagagtccccgcagacatggcggagagctggctgcgcctctcgggagccgggccggcggaggaggccgggccggagggcggcctggaggagcccgacgccctggatgacagcctgaccagcctgcagtggctgcaggaattctccattctcaacgccaaggcccccgccctgcccccggggggcaccgacccccacggctaccaccaggtgccaggttcagcggcgcccgggtcccccctggcggccgaccccgcctgcctggggcagccacacacgccgggcaagcccacgtcgtcgtgcacgtcgcggagcgcgcccccggggctgcaggccccaccccccgacgacgtggactacgccaccaatccgcacgtgaagcctccctactcgtatgccacgctcatctgcatggccatgcaggccagcaaggccaccaagatcaccctgtcggccatctacaagtggatcacggacaacttctgctacttccgccacgcagatcccacctggcagaattcaatccgccacaacctgtctctgaacaagtgcttcatcaaagtgcctcgggagaaggacgaaccaggcaaggggggcttctggcgcattgacccccagtacgcggagcggctactgagcggcgctttcaagaagcggcgactgccccctgtccacatccacccagcctttgcccgccaggccgcgcaggagcccagcgctgtcccccgggccgggccgctgacggtgaataccgaggcccagcagctgctgcgggagttcgaggaggccaccggggaggcgggctggggtgcaggcgagggcaggctggggcataagcgcaaacagccgctgcccaagcgggtggccaaggtcccgcggccccccagcaccctgctgcccaccccggaggagcagggtgagctggaacccctcaaaggcaactttgactgggaggccatcttcgacgccggcactctgggcggggagctgggtgcactggaggccctggagctgagcccgcctctgagccccgcctcacacgtggacgtggacctcaccatccacggccgccacatcgactgccctgccacctgggggccttcggtggagcaggctgccgacagcctggacttcgatgagaccttcctggccacatccttcctgcagcacccctgggacgagagcggcagtggctgcctgcccccggagcccctctttgaggctggggatgccaccctggcctccgacctgcaggactgggccagcgtgggggccttcttgtaagaggccaggccctgccccacctctggacagtgcccaagtcagggtccagaactgccccccaacacaggtccacagacaccccaccacctaggcaggggctgggccagggctccaaggcttgccccagaggccacatggccaccagccccagctgccatcagattcaagcccaggaggctgaaaacgagggcccaggaccagaatcgctgcctcctctccccagccccaccttgtacacacagtgtttcattgctccgcgtcttcccagccccagaaaccggctaaaggaccctgcaccatgagagccgaggcctggaggagcccgggtcaggctggggaggaacagaactgggccctcccagagcacctccgcttcccccctgcttccccaggtctctatccagagagagtccccaggtacaacaaatgctaattagatgacagcaaattaaccccctggaggcttctcctggcagagcctccctggggccggggcaggctgtggatggggcggagcagggcagaagatggactgggggagggggcagagagaggagaccaaaatgaggtggtggcacagggtggggcaaggagatcctctctaaggcctctggggtctttgcctggccccatccctagggggcggggaggggacgtaaatccctaatctttaagcccgacttgaggctgagagcagctggaagtttgggtttggtggtttgggggccggggcagccaagctgtatggggcaggacagacagactaatgtagtgagtgtagctgtagctgaggcttaactgggagggatgccgagcttgctggaactactgggaccaagaagcggggtaccccacgcccctgcctgcactcctcgggggcgtggggcgtgccttgctccacccggactccctgggctgcgtcccacatccaccctcctgccccgtggggcaatttaacctttttcatgaaagttatttacaatgaaaagtttttaaaaataaaatttttaaaaatctaaaaaaaaaaaaaaaaaaaaaaaaaaaa

SEQ ID NO: 299 - DNA, 3207 bp, Homo sapiens
gctaagtcaacatataacagcaaacttacaacaattatttaacatttttaaagccatgaagaagggacagagcacggagcggccggggagagcggcagagccagaggcagaggcacggctggctccccgggagggcccttgcggcgcggggcgcagtgcctaggccgcccgggtctcctgcgttgcggggagcgcagcgcaggctctcgcttgccatgagtcacctcttcgatccccggctgcctgccctggccgcctcgcccatgctgtatctgtacggtcccgagagacccggcctccctctggccttcgcccccgcggctgctctagctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaagggcggccgggcaagggcagctactggacgctggacccccgctgcctggacatgtttgagaacggcaactaccggcgccggaagaggaagcccaagccgggccccggggccccggaggccaagaggccccgcgccgagacgcaccagcgcagcgcggaggcgcagccggaggcggggagcggggcagggggctcgggccccgcaatctcccgcctgcaggcagcgcccgcgggcccctcgcccctcctggacggcccctctccgccggcgcccctccactggccggggaccgcgtccccgaacgaggacgctggtgacgctgcccagggcgcagcggccgtggcggtcggccaggcagcgcgcacaggggacggcccggggtcccctctgcgccccgcctcccgcagctctccgaagagctccgacaagtccaagagcttcagcatagacagcatcctggcgggaaagcagggccagaagccgccttcaggggacgaactcctagggggtgccaagcctgggcccggcggccgtctgggtgcctcgctcctggccgcctcctccagcctccgtccgcctttcaacgcttccctgatgctcgacccgcatgtccagggcggcttttaccagctcgggatccccttcctctcttatttccccctgcaggttcccgacacggtactccacttccagtaaagcaaacaatggcacggttcttctcccggcccagcctgagcctccgctgagcgaaaggccacagctcccaccggcggaggattttaaaatgatctttgcctgggtcggcctgtgggttcagggaagtgttaccaaccattgcgcgcaggtgggcgcgctcgcctgccttctccgaagcaaacttttcccagcaactgggagcagctacggagacttaaaagatccccgcggggtcgtgggcaccgcacgtgggccctgcagggacctccaccgcgggagattccttgacgtttgacctgtctaatggagtgtggtcttcagccgcccaccgcaggtcctgcgagtcccgggcatgcaagggcccgcagaccacccaaggcaggccttacaggtgcagttgaggtcctttcgaccggggacccccgtatgaccgtcgcctgcttcgctgttgccgtgtggctcaggccttggttttgagcccatctgggtggtgggtggtcacagctgggtttgttcctgacttgaagttgtggaggtgccgggggtgaccccgggttttcaggttttctgagagatgtagggcccgatgaggatttatgaccaatgttcagctatagaagctgataaccacccagagcaataacacttttattttaaacagagactttttctcttaatttctttctgggtagtaaaaagaacatgtttcattctttgcataaatacttgactctaagcattgacctttgaaaacgcttgtattaacaatttttattaagaaagtgcactctatataacatcttcttgcattacgatagctcattagccaatacacatgcagctatgtaagccacaacagcagacgtcctatccttttgcttttgtttttaagggatcaaaatatttcaagggataccatgaggaagggtgtgaggggaaggggatatgccttggacaatgtcagagttttgatttccatgttttttcaagatccaggcttggtggtcgctatatttttcagaaacagataatgaaagactacatttaatttaaaaagttgggtgaaacaaccaaaagcagatgcagagagagagagggatgaatgcgggggaagaataaggggacgtgctggtgtccgctggaaggggcctctctgggccccagaggacctgaggtttgatggcaggaatctcccagacactcctggcccccgcaccccctgcagccgcccgctcttccctcccagccctgccaggcaggcctggaggctgatactaaatcaaaaccttaaagaggtgactggcagtctggggaggggagaagaggtctgcaacgaaaatctaattaagaacattgagatgttcacaaccaagttcagcttgcagcttccggggaaatgcaaccgacctctatgccatctctagctgggtaatcttcgaggccctgaaatgcaattttctgaacctctaagtcacttttattttatgtcatgtgataaagacacaagtagtcacgcactattggaaataggttgggagggaggtctttaagatcgcttttaaaatagtttccaggacttgtctaaaaatgatgacaaactttgaatccagagggcctgttggtcaatgtgttggaaaggacatttcaggccggcagagtaattggataattcacaggcatagaggtgacttttggaaaattcattctcctatccatgctgaaccaggcttccacgactgggttctacccaggccagtgggaagactctgggaaacttcaggccagccttgattggaagaacttccaggaggagccattgctgagatccaggctcactgtgattcactgaaaatgtagcgaaagggctgtcactggatattttgctatcccaaactctcagcctctgtgaataaagttgttttttcattaacctctcaaaaaaaaaaaaaaaaaa

SEQ ID NO: 300 - DNA, 2917 bp, Homo sapiens
atcagaacagagcgaggctcctggcgcactagggactccaggaggcagctccgccagagacgcgggtcgtgcttcgggaaaccggggggcggggggaggggaagagcgcagaaaagaaaacccaccaaggcggggactggcctgagcggggaggggcggcgaggccggagcccctctctgttgggcggactccccatggccagaggctgagctccactcccgccggccgctccctaggggaaggggaaggagaggggagagcagcgacaggcctccagcaagcaagcgcgggcggcatccgcagtctccagaagtttgagacttggccgtaagcggactcgtgcgccccaactctttgccgcgccagcgcctggagcggagagcagaggcggcccggccgcggcgcgccggctttgtcatgatggccagctaccccgagcccgaggacgcggcgggggccctgctggccccagagaccggtcgcacagtcaaggagccagaagggccgccgccgagcccaggcaagggcggtgggggtggcggcgggacagccccggagaagccggacccggcgcagaagcccccgtactcgtacgtggcgctcatcgccatggcgatccgcgagagcgcggagaagaggctcacgctgtccggcatctaccagtacatcatcgcgaagttcccgttctacgagaagaataagaagggctggcaaaatagcatccgccacaacctcagcctcaacgagtgcttcatcaaggtgccgcgcgagggcggcggcgagcgcaagggcaactactggacgctggacccggcctgcgaagacatgttcgagaagggcaactaccggcgccgccgccgcatgaagaggcccttccggccgccgcccgcgcacttccagcccggcaaggggctcttcggggccggaggcgccgcaggcgggtgcggcgtggcgggcgccggggccgacggctacggctacctggcgccccccaagtacctgcagtctggcttcctcaacaactcgtggccgctaccgcagcctccctcacccatgccctatgcctcctgccagatggcggcagccgcagcggctgcagcagctgcggctgcagccgcgggccccggtagccctggcgcggccgctgtggtcaaggggctggcgggcccggccgcctcgtacgggccgtacacacgcgtgcagagcatggcgctgccccccggcgtagtgaactcgtacaatggcctgggaggcccgccggccgcacccccgcctccgccgcacccccacccgcatccgcacgcacaccatctgcacgcggccgccgcaccgccgcctgccccaccgcaccacggggccgccgcgccgccgccgggccagctcagccctgccagcccagccaccgccgcgcccccggcgcccgcgcccaccagtgcgccgggcctgcagttcgcttgtgcccggcagcccgagctcgccatgatgcattgctcttactgggaccacgacagcaagaccggcgcgctgcattcgcgcctcgatctctgagagcccaccgcatgccggtgcagacggatgcgaggatgcagggacgcgcgacgccggccccggtcgcagccgacgacgccgccgccagcctgacctcacaccctctgggcccgcctctggagccagcgcccagggtccctctgtgctttttcgctttcctaagctcctgtcgctcctctttgtcccctcagtttatgtcctcctgtgctcacctccctgacctctgtgaccttgcactcccctggcctgaagctgcctctctgcgcgctttctactgggctcgtctctttccggagccccagcgtctcctgcccaaattcaccgcggaaagggcccggggcggaggtgcgaccgggcgtcggcagcgcagacctcttggccttctctcacaggtcggtgcgctcgctctccgcgttccccgcccgactgccgtgcagtccatggctagacgcgccggacaggactgatggcgggaccgcgctgcccgagaaagggacggaccaatacgtgtgtttgctccgcgaaccctcttgaagctgttcagaagccgcttgccgcggggcccactaggcggggcgggggttgggacccagcgggagccggggcagcctggctccacggcctgtactcggtttacaccgcgggcgggcgcggagggaggctgcgtttcctccgctatcagtcccgtcgcttcgggcacctccgggccccggcggctggctaatgttttgtttgaaagatcggtggaactttttaagagagtatttaaaaaaaaaaaaaggaaaaaaaattcaccgggcaaccggggaagtattgtggccttggagtttgctaaatccaaatatgaaaatcaaaagctttagtattcctcatcttctcttctggaagatttgcgttagagtttttgttgggccttcaaaaagctgtgttcagagttaggagaatatatccaataaaagatggtttcgtctaccaattggggaagtttcaccctctccctatctgaagaaaaaaatcaaaaacaaatgtccccggatctttcgatgcaagtcctggaggcagggagatcactgcctgcctggcccacgctgctgggacggctcgtcctccctgctttttgtttttcaaacctcctgcttctcccaccttgggaaggagaaatgtgaaacccggcagcggccgacctaggcggtcttgtggcccggagccggcccggcccgaaaaccatagacctggttgtactgtagcttgttgtttgggggaccaaattttctagagagaactagagcacttttgttgtgtttttttgttttgtttttgttttttgccttgtcgattcccgaataaattttgtgttccttcttttaa

SEQ ID NO: 301 - DNA, 3527 bp, Homo sapiens
actgaaagctccggtgccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggacaaaaaaaaaaaaaaaa

SEQ ID NO: 302 - DNA, 1344 bp, Homo sapiens
ggggacctgcagtcgctgtcgtggctcacggcggtggatgtgcctcggctgcagcagatggcaagtggccgcgtggacctgggtggcccctgcgtgccacatccacacccaggtgccttggctggggtggccgacctgcatgtgggagccactccaagtccccttctccatggcccagcaggcatggccccccgaggcatgccaggtctgggccccataactggccacagagacagcatgagccagttccccgtggggggccagccctcatctggcctgcaggacccgccgcatctgtactcacctgccacccaaccacagttcccgctccccccgggtgcccagcagtgccctcctgtgggcctctatggccccccatttggggtgcggcccccctacccccagccccacgtggctgtgcattcatctcaagaactgcaccccaaacactaccccaagcccatctactcgtacagctgtctgatcgccatggccctgaagaacagcaagacaggcagcctgcctgtgagcgagatctacagcttcatgaaggagcacttcccctacttcaagacggcccccgacgggtggaagaactcggtgcggcacaacctgtctctgaacaagtgcttcgagaaggtggagaacaagatgagcggctcctcccgcaagggctgcctgtgggctctgaacctggcccgcatcgacaagatggaggaggagatgcacaagtggaagaggaaggacctggctgccatccaccggagtatggccaaccctgaggagttggacaagctgatctccgaccggcctgaaagctgccggcgccccggcaaaccgggggaaccagaggcccccgtgctgactcacgccaccacagtggccgtggcgcatggctgcctggctgtctcccagctcccaccccagccactgatgaccctgtccctgcagtcagtccccctgcaccaccaggtccagccccaggcacatcttgctccagactctccagcaccagcccagaccccgccactgcacgccctgccggacctcagccccagcccgctcccccaccccgccatgggaagggctcctgtagacttcatcaacatcagcaccgacatgaacactgaggtggatgccctcgacccgagcatcatggacttcgctctgcaggggaacctgtgggaggagatgaaggatgagggattcagcttggacacactgggcgcctttgcagactccccgcttggctgtgacctgggggcctcaggcctaacccctgcctcgggtggcagcgaccagtccttcccagacttgcaggtgacgggtctctacacagcgtac

SEQ ID NO: 303 - DNA, 5738 bp, Homo sapiens
gcagccgccacattcaacaggcagcagcgcagcgggcgcgccgctggggagagcaagcggcccgcggcgtccgtccgtccttccgtccgcggccctgtcagctggagcgcggcgcaggctctgccccggcccggcggctctggccggccgtccagtccgtgcggcggaccccgaggagcctcgatgtggatggccccgcgaagttaagttctgggctcgcgcttccactccgccgcgccttcctcccagtttccgtccgctcgccgcaccggcttcgttcccccaaatctcggaccgtcccttcgcgccccctccccgtccgcccccagtgctgcgttctccccctcttggctctcctgcggctgggggaggggcgggggtcaccatggccgaggcgcctcaggtggtggagatcgacccggacttcgagccgctgccccggccgcgctcgtgcacctggccgctgcccaggccggagtttagccagtccaactcggccacctccagcccggcgccgtcgggcagcgcggctgccaaccccgacgccgcggcgggcctgccctcggcctcggctgccgctgtcagcgccgacttcatgagcaacctgagcttgctggaggagagcgaggacttcccgcaggcgcccggctccgtggcggcggcggtggcggcggcggccgccgcggccgccaccggggggctgtgcggggacttccagggcccggaggcgggctgcctgcacccagcgccaccgcagcccccgccgcccgggccgctgtcgcagcacccgccggtgccccccgccgccgctgggccgctcgcggggcagccgcgcaagagcagctcgtcccgccgcaacgcgtggggcaacctgtcctacgccgacctcatcaccaaggccatcgagagctcggcggagaagcggctcacgctgtcgcagatctacgagtggatggtcaagagcgtgccctacttcaaggataagggtgacagcaacagctcggcgggctggaagaattcaattcgtcataatctgtccctacacagcaagttcattcgtgtgcagaatgaaggaactggaaaaagttcttggtggatgctcaatccagagggtggcaagagcgggaaatctcctaggagaagagctgcatccatggacaacaacagtaaatttgctaagagccgaagccgagctgccaagaagaaagcatctctccagtctggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggcttggtgtctttcttttctaattatgcagaataagctctttattaggaattttttgtgaagctattaaatacttgagttaagtcttgtcagccacaa

SEQ ID NO: 304 - DNA, 7341 bp, Homo sapiens
gcgcgaggccgtcgattcgctcgcggctccatcgcggcctggccggggggcggtgtctgctgcgccaggttcgctggccgcacgtcttcaggtcctcctgttcctgggaggcgggcgcggcaggactgggaggtggcggcagcgggcgaggactcgccgaggacggggctccggcccgggataaccaactctccttctctcttctttggtgcttccccaggcggcggcggcggcgcccgggagccggagccttcgcggcgtccacgtccctcccccgctgcaccccgccccggcgcgagaggagagcgcgagagccccagccgcgggcgggcgggcggcgaagatggcagaggcaccggcttccccggccccgctctctccgctcgaagtggagctggacccggagttcgagccccagagccgtccgcgatcctgtacgtggcccctgcaaaggccggagctccaagcgagccctgccaagccctcgggggagacggccgccgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaaggaaaaaaaaaaaaaacaaaaaagtcctgttttgctttgcagaacaaatgaacttacaggtgagcattaagcttgcagtgagaaatgtgcgaagagtaaaaacccaagtcaatgctgaggcagttctaacttcactgttttcctaaatacacatccttgattattttcagccttgctatataatctgatctgctagaagtgtatgagtgagaggcaatagcatacaaactgattttttaaatataagcttaggttgtaattgtacaagtgactcaatggaagtacaaaatagggcagttttaacttttttttctgcttctatggatttcattttgttgtgttttcaaaaagttatggtgctgtataggtgctttctgtttaacctggaaagtgtgattatattcgttaccttctttggtagacggaatagttgggaccacctttggtacataagaaattggtataacgatgctctgattagcacagtatatgcatacttctccaaagtgatatatgaagactcttttctttgcataaaaagcattaggcatataaatgtataaatatattttatcatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtgtaatttttttaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgtgtggggatgcattgcagaggcactagtagcatgggggctagagtggggagcgagatgtaaaagggtggggggataggagaattccagagtgcttccagcattagggtcctgagaacttctgagttcagagaaacatgcaaagtgactaacaaaatagctacttacctttgcagttttacagaccctgggagctgctttgggagtgagaaaggcaaccctccaatgtgtttcaactttaaaatgttgaattcttttcagacatggtatctcatttattctccttttctagcgtttgttgaatttcaggcagaatgtcttacagaatgtcctagaaccagattatcatttaatctgaaacagctgaggaagggacagagaaggtacaagggcaaggcagcacaaaacagatcaggagaatgaagagggaatgctttggttttttgttttgttttgttttttctttttcaagtaactaaaacagcatctacatgtagagtgttgtggagagctgagaccagggtaaagtcaagtgcagcatcagtactgcgagacccaccagcccctggagagggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacaggtccctaacaataattttctgatctggagcatatcagcagaatgcttagcctcaaggggcctggcagctgtaatgtttgatttatgatgagaactatccgaggccacccttggcctctaaataagctgctctagggagccgcctactttttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatctgagcttggtttcctttattgcttcctctgcaatatgattgctgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaatgttatccagcctgaccaacatggagaaaccccgtctccattaaaaatacaaaattagcctggcatggtggcgcatgcctgtaatcccagctactctggaggctgaggcaggagaatcgcttgaacccaggaggcggaggtcgcagtgagccgagatcatgccagtgcactccagcctgggtaacaagagtgaaactccgtgtcaaaaaaaaaaaaaaaatgttactcatcctctctgaaagcaaaaaggaaaccctaacagctctgaactctggttttatttttcttgctgtatttgggtgaacattgtatgattaggcataatgttaaaaaaaaaaatttttttttggtagaaatgcaatcaccagtaaagaggtacgaaaaagctagcctctctcagagaccggggaggcagagtactactagaggaagtgaagttctgatggaatcatgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtaaaaactatcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactct

SEQ ID NO: 305 - DNA, 1446 bp, Homo sapiens
ggcacgagctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaa

SEQ ID NO: 306 - DNA, 3633 bp, Homo sapiens
cttgaacctttgtcacccctcacgttgcacaccaaagacataccctagtgattaaatgctgattttgtgtacgattgtccacggacgccaaaacaatcacagagctgcttgatttgttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggcaaattgcttgttttcttcttcttcttcttctttttttttttttttttagaaaaaaagacaaaaactgattttcttgaaaaaaaaaaatgaactgttctttctataatggctttgcccatttaaaaaatgtggctcttaagggttcatgaaatgactgaatatgaggatacatgtcctgtagaaagcaaatgcgcctcatatactgccaaaaatagtgttagtttcattaatgtgaattttccagcattcagtagttgtaatgttagaaacaattgctggtcaagttcaacttgttgctattgtttttaatttgcacaggagtagtatcagaaattagtgtcactgcttgtatctagctgaattttaaacaacagaacattagttttttatgttggtgccaccaactgtaaatgacataagttagttattacaaaacacagtaattagactgttgcaaccatctaaaaccttaggcttccagtctgtgctgttagtgttaagatgtaaagtgcaatcctaagctaacattatctgtgcaagcaccatagaaacatttgcatatctgcatagatcttacaactgtactctttacctccttgtgataaagctttgtctacctgcaaacacagtcaaaggctacagctgcaaaccaaagccaactctaaccatggccaagagctcaaggacagaagcagccacatgctttggtcagccttctgtaacttcaattagtacaaaggaaccttttccatgaactacctgctgttttctgatgacctctgggatcttttcatttagccctaaacaaagaaacaaatatgacaaaaaccacaactaaaaaatgttaattcagtcacagagtaatcttctgaggccaaaagtccatctaaatgcaatgaagatttgctttcattaaagacagaggtgaggacaaaatc

SEQ ID NO: 307 - DNA, 2397 bp, Homo sapiens
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctgcccacactgcccctagtcatggtggcaccctccggggcacggctgggccccttgccccacttacaggcactcctccaggacaggccacatttcatgcaccagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctccccacaaaaaaaaaaaaaaaa

SEQ ID NO: 308 - DNA, 5926 bp, Homo sapiens
gccgtccctgcggaccggacagtgcggccggcggccggcggccgggacggagcccccagcccgcgaggagggcgcggcgcaggcggcggcggcgcggcggggaggagcccgggccggaaccagggctgggccgggggcggggacgccggggtccgggagcccgggagccggagcgagctgacgagcgtcgcggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccagtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccgggccctgtgtgtgtcaccgaggtgcgggaggggaggagcattaaagctgaaagatcgctctgctcggggagcctgggcagagcagcagcaacgtgagggtcgctgtggtggtggtttctgtgagtggatggaatgagcagccctgcaggggcgctgggcatgtgccctcactgtggacagggcccacccacctccggttcccctgtgcctcctgtcccttccacgcttaaacagggttctctgtcattttcctgttttcttccagagtcccaatcctttgccctagttctttcactagtttgaaatccaagttcttgccagagtgttggagcaaggcagctgatttgctgcagggatggagaggaccaccgccgcagggttcttttacctgtgccaccagctctggagacatccacacccattcccaggtgtccttccaggcccattgtccacgtcttcaagggggctgcctggataggcgtgtgtgtgtgtagtgcccaggtgtggtggtggcatcctgaagcagtaggaccattagtgtgcgtgcacacccacgtggcacactgtgtggtgaccatggtcatcatagtgggctcacggcggaaacgggatcattcaacctatacaaaggggaccctggataggctgcaaggaaagaggccaagggccaagctgctaagccaaagatggcccctgacacctcccccagccccagcacaccagcctgcacctcttatcccgtgttaagtcctggttccccacctgctgcccctcctcaacacagagcccctcccgccgcctcagacccctgtgcacatccccagggcctcagccgtctcattggtctttattttttattttttttaagatggagtttcgctcttattgcccagactggagtgcagtgatgctatctcggctcactgcaacctttgcctcccaggttcaagtgattctcctgcctcagcctcccaagtagctgggattacaggcgtgcaccaccacgccgggctaaatttttttgtatttttagtagagacggggtttctctatgttggtcaggctgatctcgaactcccgacctcaggtgatccgccagcctcagcctcccaaagtgctgggattacaggcgtgagccactgcacccggctctcactggtcttacgccaccttctggacactccctccttgagggcagaaaggagtcccaggcctgtccctagggacaaggcccagggaagagtgtatttggggagcaggggaggggagggtgttgagaaagctgaactggagtcaatcacccttcccacaaatcaccaaactgctggaactctccagccaaatgctgggagaaggacctggagggtgagtctttgctgacctctctctactctcaggcatgtcttttgtccttttcgtccatctatttctgtctgtcgctcactcgccccgctttctctgtctcaccttcatccactctgcaggcctgctccaccacagccctaatcctctggacgcttgtgtagggcctggggtgaattccctgtcccccatggtacctcgagaggggctggggagctcagcttggtctcagagtctccccaccagatactgtttaaaaaagtagcactgatgtgttttgtaatctgcccctcccagccctccgtggaggctgccagggccttgtacggtaaacctagctgcatgtaatctgtggacaatggcattctctacaatgcaataaaaacaattacccatgaaaaaaaaaaaaaaaaa

SEQ ID NO: 309 - DNA, 2338 bp, Homo sapiens
ctcaacgtcgaaccgaaggcgacacccacccaactcctccctctccgccccatagtccacccaacacttgcagcccctccagagaaaaagcccagcggaagaggactccggaaaagtgactatctcggaagaccagggtagagctcccgggagaaaaaggcgaagatccccggccccggatcgccatccccttccctggcaccagcttctctaggctgcgcgaaggaagagggtacgacgccggggagggactgggtgcgcgggcatgaagttggaggtgttcgtccctcgcgcggcccacggggacaagcagggcagtgacctggagggcgcgggcggcagcgacgcgccgtccccgctgtcggcggcgggagacgactccctgggctcagatggggactgcgcggccaacagcccggccgcgggcggcggcgccagagatacgcagggcgacggcgaacagagtgcgggaggcgggccgggcgcggaggaggcgatcccggcagcagctgctgcagcggtggtggcggagggcgcggaggccggggcggcggggccaggcgcgggcggcgcggggagcggcgagggtgcacgcagcaagccatatacgcggcggcccaagcccccctactcgtacatcgcgctcatcgccatggccatccgcgactcggcgggcgggcgcttgacgctggcggagatcaacgagtacctcatgggcaagttcccctttttccgcggcagctacacgggctggcgcaactccgtgcgccacaacctttcgctcaacgactgcttcgtcaaggtgctgcgcgacccctcgcggccctggggcaaggacaactactggatgctcaaccccaacagcgagtacaccttcgccgacggggtcttccgccgccgccgcaagcgcctcagccaccgcgcgccggtccccgcgcccgggctgcggcccgaggaggccccgggcctccccgccgccccgccgcccgcgcccgccgccccggcctcgccccgcatgcgctcgcccgcccgccaggaggagcgcgccagccccgcgggcaagttctccagctccttcgccatcgacagcatcctgcgcaagcccttccgcagccgccgcctcagggacacggcccccgggacgacgcttcagtggggcgccgcgccctgcccgccgctgcccgcgttccccgcgctcctccccgcggcgccctgcagggccctgctgccgctctgcgcgtacggcgcgggcgagccggcgcggctgggcgcgcgcgaggccgaggtgccaccgaccgcgccgcccctcctgcttgcacctctcccggcggcggcccccgccaagccactccgaggcccggcggccggcggcgcgcacctgtactgccccctgcggctgcccgcagccctgcaggcggcctcagtccgccgccctggcccgcacctgccgtacccggtggagacgctcctagcctgagtagcgccgcggggcccgggaacgccgagtgcgcgccgtcggggaggcgggaacgcgggcccgcgcgcggactttgcactttgaatccagaggaagatgaatttttaaaatctccatcaaacgtgccttaaagctaaagcattttgacaggagtatttaaacttagtccaggatattttcctttgtgttttataactttacagaggaccaaagcaattcttgttttagtttctttgcgaagcctgctcctccttcccttcataaggactttttttgtctttctttaacgcccaggcttcgtcttatttctactgtttttgtcgcaacttccattgatttatgtcccttccctcccccctaagtacatcagggaacctttccacactataaatgatatgactactgtttggggtttctgggcccccatccgtgtacgtatgtggcatttccaggtatgactgagtgtgagagacatgtcagaggctcttcagtgatttcttgctattgaccgatgcttcactgtgccaaaagagaaaaaaaatgttgggttttgtaattaaattatttatatatttttgaaacccgaattgaaaatgttgcaggcaacgggctacagctttattagtggttctctaactgtggtctccttgggccaagcaatttctttaaaggaaaagttgattatgtatgtggggtgccaggaccactgccttgaaagcaagtgtgatttttatttttaatattattttatttgtgtctgtgtacatattcatgtataaattttatgaaacccaagcatagtgcttattttttaataaaacaactgacttaacacattgtgaaaaaaaaaaaaaaaaaaaa

SEQ ID NO: 310 - DNA, 5009 bp, Homo sapiens
ccggcccggcccgcccggcccagccgctcctgctgggcgccccaaccgggtccggcccgggggggcgggggccgcggccgccgaggatggggaaatccaacagcaagttgaagcccgaagttgtggaggagctgaccaggaagacctactttaccgagaaggaggtccagcagtggtacaaaggcttcatcaaggactgccccagtgggcagctggatgcggcaggcttccagaagatctacaagcaattcttcccgttcggagaccccaccaagtttgccacatttgttttcaacgtctttgatgaaaacaaggacgggcgaattgagttctccgagttcatccaggcgctgtcggtgacctcacggggaaccctggatgagaagctacggtgggccttcaagctctacgacttggacaatgatggctacatcaccaggaatgagatgctggacattgtggatgccatttaccagatggtggggaataccgtggagctcccagaggaggagaacactcctgagaagagggtggaccggatctttgccatgatggataagaatgccgacgggaagctgaccctgcaggagttccaggagggttccaaggcagacccgtccattgtgcaggcgctgtccctctacgacgggctggtatagtcccaggctggagctggatgcctgggaaccactcacctccttctgtgccatgaggccacctcagccctgacaccaaccccgtgcgtccacccagccttcttccgcatccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgcttttgttttttattttgaacagacgttttaaaagaaaaaaaaacaactaccttctgtcctagaagacacagactgacagatggggtgaaggcctggggacctcagagaactctgccttgccctcgtccctcgtccttcggcagccggagaggctgtgggtgggccgagggtgtctaggggttctgcctggtcaacgttatttgtcgtcccatcttttggcagcaaaaccacctgcgtggctaggatgattaattatgaggatgatgattttttttgtgataacagtattgtgctttttgtggggaaagtgaggtttttttttatatacatatataattgatatctttaatttattggttgttaactgttgctgctgcctggtgtgtcctcagctcccagggctgcgggcccaccgtttacatgtgcacgccctgacccacctgcccacgccgacttgggaggatggtggcctgcagcggccaagaagccaaaaaaaattttttttttttcagatactgtgcttgatttttggagaggggagaggtggaaattcctaaatggctaatgcactgttccctccagcccgaatgcctcctgccaaaccccttttccctgctgcctctgtccccgcatccttgttctcccctgggtccgtaacattttttccgaggatgaacaggggacatctttaggtttctcaactcttgctttggtgtttgccgcagcatggaaaacagggcgcctaaggctgggagctggaagaaggggcattgggtacccaggcagagtcaggagaggtggtctttgaagtaagttagcagaaatcaaggggacccccgcctccttgggctggggaggggatttcaagatagttcatgactctctcccgctctgccttccctccttcctatctgctttttccagtaaactgcatggtgtccttccctggccttctcttggctcaaaggctgggagggagggaaggagagaagagttccaggcaatcccatcaatatagtccctacacctggggctgcggcccacatgtcttcacggaggcttccagcggtgcctgccactgaggcaggtgcggccccaggaccatcaccaggaatgcgaggccaccctggaccagaggtaggagcccaaggtccggcccttgctctttgattgtgggcagcctcctgccctctctgggtctcagttgccccatctgcagagcgaggaggcccgggctggttggtcttgaaggcccttttccatgccgacatcatgtcactctaggcctggggttcagtttcctgtggctggtgatgctgtggttaagtttgcttgaccccagcagcccgagggactgtctgagtcacagcacagcccctattgcgtggctgctggtgtgtggggtcagttccagcagatgaatgtgtcatgtggcacaccttgtcccttcccgcagcatttcctggttccccccagacccttgagcgctctttgggacccagaaggagtccttgcacagggaaggcttgaggtgagaagccgcttcccagactgtcagggccaggcctgggtctagaattcttgctgctgctttgcagagtcaacagcccatcagcccatgttttagaggggacactttggtcctcggttcccaccctcagcaagcaggcctccagcccgaggaaggcctctgccgtagtgacgttgccgtgtggggctgcgtggctgttccccttggctggagcattcagccaaccccagcgtcccccctgaggcgttcattggcagccccctaggactgcacgctggccccacggtaaccccccctcccccaccaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtccggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcacgcccatagtccctctgcagagcctcgcactggggccagggcaggcaccagccccaggcggccagtcggccacggcctgtcctcttcctcgtagcgtctgctcctcactttgtgttgatggtgacttaggagaatgttccgattttccatgatctaagcaggccacgtttaaaataacatcaaggcaagcgtacgtgtcaccctctgtactgacatctcttcccctgaaatgcttttcagtttgacagcccgtttcctagacaagtgcacctggggtttcaggaactttgtgttttttcggagggggttggtggggaggtcgggatgcctgggatcccttcctggagaggcaggctgtctctggaaaaagcctccattgcccacccgccaggcggaaagtcaccctgttcccagcgcggtttcagcatttaattttaagggagctaaggaagcgcggcgcgccccctggtggtggtaagccgccaacgcacctgggggctgcaaccccaccggacgggtggtccggagggaggctggagcggggaggcgaggagggggctgtgagtcctcagaggccctgggccaccacatttctggcagcgtttcccagacacccctctgctaggccatccctggatagcaagtgaattaacttaagggcactgtgatgggaagccttgcccccctcttttttttttttttttaatatctgcggaataaacccaatggttaatttttgaatgaataaaaggcttttgttgaataaacagctggtcccatcttctgtcttggcatcttagcatccaggctcaggctctgccccttctccaggatggggtagccccgagtcgccctccccagtctgcacattccctgttgtccctgttcctgcagtggctcccggccccagggaggcccacctcactcccagcctgactcggtggctggcttccttcaggactttgcgcaagtcagttctgctcattgggtctcaatttccccatcccttggatgggagcaagagtctctgctgggcctgcctcgcaggggcctggtgagacccaaatgtgagtgtcatcatcaaagcccctcacagaagtggaggacggtgcccaagagtagcggtttggactgctgctgcctcccacccggagcctgccacttgggggagaaattggtataatgcttgcaaaaacaaacaaacaaaaggcaatgtcttctggttgtggttatttcctttcctgcttgcctccccagccccctttgagtctctttttggggtgccgtcctgtctgaacctgccggtgtgtgtctctggggccagggtcagggcgaggcccaggggtggacaggggccgtgtagcatgccccagcctccccaagctcctgctgtatgtcgtccatgtcacgccaattaaacacgcttcctggacttgtcctcgccaaaaaaaaaaaaaaaaaa

SEQ ID NO: 311 - DNA, 2884 bp, Homo sapiens
agcttcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataa

SEQ ID NO: 312 - DNA, 2336 bp, Homo sapiens
ggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaaacagagtcacgccgccagcgctgctcctcaggccagctccccaccagactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtcaaaaaaaaaaaaaaaaaa

SEQ ID NO: 313 - DNA, 5182 bp, Homo sapiens
cgaccggacgggtctaggtgagacagaagccaaacaggaggaggaagtggagggtaagtgcttccgggtcccctggcacagcctccgccatcttttcttcgcctaatttgacccgttctttttcccctccttgaaaccttgctctgtacgcatgcgctctttgagtggcctttcccctagttcaagctcccctccgagtcagcgtcctgttcgttagggttatcgaagtgtataaaggtgcagggaaagtgagactgtgtaaaacaaagcggattggggcgttgtgcttccttgtacctcgtgagcctccgttgccttgggcggtcgttttgcgcaccctgccgggagttgtagtcctggacccgaaggtgcctgggaggcgggaggggggttggggcttctcagcgccgattccgcgggaagggccctgggacctcacacttctagtcgcgggagctgcaggtcttacccggagagacgctgcacgtggagccctcgccgctgccgttctcagccggctctggagtgcgggcgggggcgacagggccgattccggagtgggactgatcctttgaaatactccagccatgactaaaagagaagcagaggagctgatagaaattgagattgatggaacagagaaagcagagtgcacagaagaaagcattgtagaacaaacctacgcgccagctgaatgtgtaagccaggccatagacatcaatgaaccaataggcaatttaaagaaactgctagaaccaagactacagtgttctttggatgctcatgaaatttgtctgcaagatatccagctggatccagaacgaagtttatttgaccaaggagtaaaaacagatggaactgtacagcttagtgtacaggtaatttcttaccaaggaattgaaccaaagttaaacatccttgaaattgttaaacctgcggacactgttgaggttgttattgatccagatgcccaccatgctgaatcagaagcacatcttgttgaagaagctcaagtgataactcttgatggcacaaaacacatcacaaccatttcagatgaaacttcagaacaagtgacaagatgggctgctgcactggaaggctataggaaagaacaagaacgccttgggataccctatgatcccatacagtggtccacagaccaagtcctgcattgggtggtttgggtaatgaaggaattcagcatgaccgatatagacctcaccacactcaacatttcggggagagaattatgtagtctcaaccaagaagatttttttcagcgggttcctcggggagaaattctctggagtcatctggaacttctccgaaaatatgtattggcaagtcaagaacaacagatgaatgaaatagttacaattgatcaacctgtgcaaattattccagcatcagtgcaatctgctacacctactaccattaaagttataaatagtagtgcgaaagcagccaaagtacaaagagcgccgaggatttcaggagaagatagaagctcacctgggaacagaacaggaaacaatggccaaatccaactatggcagtttttgctagaacttcttactgataaggacgctcgagactgcatttcttgggttggtgatgaaggtgaatttaagctaaatcagcctgaactggttgcacagaaatggggacagcgtaaaaataagcctacgatgaactatgagaaactcagtcgtgcattaagatattattacgatggggacatgatttgtaaagttcaaggcaagagatttgtgtacaagtttgtctgtgacttgaagactcttattggatacagtgcagcggagttgaaccgtttggtcacagaatgtgaacagaagaaacttgcaaagatgcagctccatggaattgcccagccagtcacagcagtagctctggctactgcttctctgcaaacggaaaaggataattgagccccaggacattctgagactccaaagtctttcttaaaatgtttagagcaagtatagctcttacctttattactgaatttgaatcttcttttatttctaggctgtacagtctgatgcatgatttttttataaatatttcatactcttgtgaatttggatctttttactttgagcatatattttagaatatgtgtatgttaaaggatctccacaatgtctgcagtgtgaaggcaggttcattgtggaatagtttaacagtcaggaaggctaaactggtcagtattaatgtgtagccctaccaaaaatagccagtagtatctgaaaatgaaaaataaatgaagtatctctaggaaacagtctggcttaactatttttgaaaatataactgtttcccctctctgctgctttagatgttgctttacatagaaccagaaaatggaatttctcagctaaagcatgtgtgcctgtttcatctaatcaagcagagctaaaatgttcataccgaataaatttatattaataaattactaaactaagagtatcaggttatttatatatttgcaagcaaaggacagtaagaagttgactggcaaaagagcagtgctgaaggaggagatccaggtttaaatctggcttattaactcaagccaattttaaggattttctgtatagattactcatgtcagaccaagaatttaaattattttgagagaggcatttaattctaataaaccagctgttataaaaattataaaatgatctctgtttttcctgtcagagatttaaaaaactgaaaaggtatacctcaacccaaaaataaaggtttgttttggtttgttatggcttccttttttaaaaaattaccctgtagtgccagtttattatgcaaagcagcttatattcctttgtttctgataaaatgaagactttaaatcagtcagtagtactttacctttcaaggcattagtaaattacttgcaaatagttttaaaaggaaaatacgacctttgttataggcagtcttctctttaagacaatacttttccacttgttttccttttccatattatatatgtgtattcatatagctgtatacatattcagttgatcattttataaacatatgaaggcataaagatatacagaagaaaaattattaaacaactcattttaagattcaaattaactaattcctgcatatatgacattccttacataagcgaacactaaacaaaaatggctagaaatgtctttttctttcttttctctctttgttgtttaaggtattaagcacgaattattacatgagactggcagatagctattaatcctcttacagatttgagaaagttgattctcaaatatttatgcaccttctccttcattgttttctttaaatctgtcctcttaaaaagcttcttaagagctcagttaatgcttttgacttaactaggagaaaaaggcatgataatacaggcaagatggcattgttagcaattctggtagtggtttggaatgaatcctaagaggcagggatcttaaggacaaggaagagaagagagagagggagggatctttgatctctttctctggtaatcttaatgcataattttactaaaacatgttctcaattcattcatattattaagctcttcctgcagttgatatctgagcagagtaagatttgtatttccatttttacttttttgaaagagaatatatggacagattattagtacaatttgggcactgtggttttaagaatatctgagtaaaataacaatatgaaataataaacagaagctctaacgtcaggtaacaaatagacagcaagaaaggttttgcaccatcctcttacggcctagagagttgacaagttgcttgtagttttaaaaaaataataaagtatacccttctggtatatcatcaagagcttaagaatcttggctttcatatttaaaatgcttttggggagacatatattaaaattttagccaagatgatagacatgtctcaattatatatgtgtgtgtatgtttttaaagctaaaaacattacttttagatccctagaatgaaaatttttttctcatctatgcaattcccatatggtttttttttaaatcatattttattcattttctccctttagcaattttcattttatttctcataatttgaacagagacagttctcatacatgatcagatgctttttttttcttcttaccatcatttatgcatgacataggtaatgtgactaatttctccagttgattcaagaaactcattactttgcctcaaattatatgtaaaatatttgttttacttaggttacagttatcagaaaggtagtttttttcttctattaaaatataacattgtgaaagaaaataaaatttatgctattctttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaactttcatacatatcttgctagcctaaagtctaaatatttgtgttggcatcagaaaaacaaatgaggcagaattgctatgtgtggttgatcttcagataaattgactgatcacagttatttttgtatcagtctatgttattaggaaaaattgtttagttgttttctcccctgattaatggtgatattcaagtatgatacaaaaagaattgtaccaccaaatatttttgtgaggtctgctgttttccatattcattttatgctactgcctttaagaaagaactagtgtatccttgaaatagcacaaaaatgttttaaaattcataattgcaaaacaaatctgtgactaacttaatgtcttcagatctaaagggtgtaaaaatattgatacttcaatatttcacttgctgccaggaaaaacaaaattctcaatcttttgtaaatgggaggaggacttttgcatacatttttactctttaaataacgacaacgacacttatactgtcataataacaattatgtatttctttgtggttttaattttttttgtaattttacataaaacagttattttctatttttacgcagataaatatttgtgcataaaatgtaaaaatagtaaaatgagaaaaataaaactattatacagtaaa

SEQ ID NO: 314 - DNA, 3069 bp, Homo sapiens
gctttctttgtgtggctgaagcgctagaaatggcatattttctttcccttcgttaaaaaatcagaccctctttcccctctctccccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacaggtctggtatcttcagaaaattcatccaaggcaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttttattgctttatgaactgtttaaccctgaaatccctctaggttatctatactgtataaaaaagcaattacccttaaaactgtactctggcctacttttctattttgcaattaaatatctttttcacatatgttcattgtagacttatgtttttatcacatcttattaacacattaaaaatgttatcctactgcaaaaaaaaaaaaaaaaaa

SEQ ID NO: 315 - DNA, 1622 bp, Homo sapiens
gctttctttgtgtggctgaagcgctagaaatggcatattttctttcccttcgttaaaaaatcagaccctctttcccctctctccccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattcaattttttttgtcttttatatttattactgacagtattgttttgatacagaatgaaagtgcgtagtattttcattttgtttatttttgccttatacatatagcaagccctcaataaataaatattgaatgaatgaaaaaaaaaaaaa

SEQ ID NO: 316 - DNA, 1404 bp, Homo sapiens
cggcgttctccacctgcgcgggcctgaatggccttcaggagcacagtcggcctgaggagttgacggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatcctaaaaaaaaaaaaaaaaaaaa

SEQ ID NO: 317 - DNA, 4182 bp, Homo sapiens
gggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctactggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgattggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgatttgtaagtgctggcagatgccacttggggacctgccaagtgaattccttgtcctcacctcatgtttcccaagcccagcaggaaacatacttgggcttttggattaattctaaaaaaagccaatgcaacattttccttagtggaacctattgaatgcaaacttcaaattcaaccaaaatcggggaaattaatgcatgtgctttacttttcttctaatgaagtcacatgatgcttctttgtgttgacatttattggtgcacaaaaatacttactgaatgtgtgctctgtgtaaaacaccaggagcaaacaaagataccatcaaggcatttgcaatcttgttagtagaagcaacattaaaagtattcaggagtagatcaaaggggactcggcataattgaatgtctgtctattcttttataggtttttcatggattgactaccttctgtctcagaaagttactgatgtttgtgtcagttcatcattaagctaaactctgactttcataataaaagggataaacaaagcctaaatgctagttgtgggaatactaaagcagttttttaaaaaggaaatagtagtttcatgccctcacataccattaaaagatgaacaaacatggacaaatattcaaaactgcagtcattgaaaaatataattcacaataatttagacttcatattattgtatcataaaatattcagtggaccctgaaatgaagtcagttttattcatttagaattatatctattgtgtctgtgaaatgataaatcctaaatagagaaatttgaatggatggggtttttctgactaaaatgaaattttttttctgaataattcagtttagtgagtgcttatgatatacttgtctgcagtgatagagtcactatagattatttggttattttggaaaaaccaagggttttcttaaatcagggatgtccaatctttttgcatccctgggccatacttgaagaagaagaattgtctttggcctcacataaactacactaacaatagctgatgagctacc

SEQ ID NO: 318 - DNA, 1501 bp, Homo sapiens
gacaccccctgggatcacactgagcttgccacatccccaaggcggccgaaccctccgcaaccaccagcccaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtgaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctgattgtcagtaaacgggcaggtactcagtgcaccaactgccagacgaccaccacgacactgtggcggagaaatgccagtggggatcccgtgtgcaatgcctgcggcctctactacaagctacaccaggtgaaccggccactgaccatgcggaaggatggtattcagactcgaaaccgcaaggcatctggaaaagggaaaaagaaacggggctccagtctgggaggcacaggagcagccgaaggaccagctggtggctttatggtggtggctgggggcagcggtagcgggaattgtggggaggtggcttcaggcctgacactgggccccccaggtactgcccatctctaccaaggcctgggccctgtggtgctgtcagggcctgttagccacctcatgcctttccctggacccctactgggctcacccacgggctccttccccacaggccccatgccccccaccaccagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctgaaaaaaaaaaaaaaaaaaaaaaaa

SEQ ID NO: 319 - DNA, 2729 bp, Homo sapiens
tcgagatccattgtgctctaaagggagtcggcagctggcgccagggcggccggaggatgccgaggggccggagccgggcgggcccgagcgcgaggcgcactctacccccagctcctaccctgtaagccccgccagcctccggacgtgctgtccctgggcccgtcgccctcggggctcccgccggaactccttcactctcagaggccgagtccctcccctccccacggctgcgtgtggccgttgccgtctgcacccagaccctgagccgcccgcgccggccatggaggtggcgccggagcagcccggctggatggcgcacccggccgtgctgaatgcgcacgaccccgactcacaccacccgggcctggcgcacaactacatggaacccgcgcacgtgctgcctccagacgaggtggacgtcttcttcaatcacctcgactcgcagggcaacccctactatgccaaccccgctcacgcgcgggcggccgtctcctacagccccgcgcacgcccgcctgaccgggagccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggctcctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccggatgggtggaccaaacccttagcagcccagcatttcccgaagccgacaccactcctgcctgcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggccagggagggtgagctggtgcctgctttgacgggccaggcctggagggagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagcacagcctgtcttgtcaggtggaccctgtaaatacatccttttttctgctaacccttcaaccccctcgcctcctactctgagacaaaagaaaaaatattaaaaaaatgcataggcttaactcgctgatgagttaattgttttatttttaaactcttttggggtccagttgattgtacgtagccacaggagccctgctatgaaaggaataaaacctaaggttgggagctttgcaattctttttgggaaaaggggcctt

SEQ ID NO: 320 - DNA, 3067 bp, Homo sapiens
ggcgccgtcttgatactttcagaaagaatgcattccctgtaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaagaaaaaagttgtaggcgaatcatttgttcaaagctgttggcctctgcaaaggaaataccagttctgggcaatcagtgttaccgttcaccagttgccgttgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaatttttggttgaataaactagattacattcagttggcctaaggtggttgtgctcggagggtttcttgtttcttttccattttgtttttggatgatatttattaaatagcttctaagagtccggcggcatctgtcttgtccctattcctgcagcctgtgctgagggtagcagtgtatgagctaccagcgtgcatgtcagcgaccctggcccgacaggccacgtcctgcaatcggcccggctgcctcttcgccctgtcgtgttctgtgttagtgatcactgcctttaatacagtctgttggaataatattataagcataataataaagtgaaaatattttaaaactacaa

SEQ ID NO: 321 - DNA, 3419 bp, Homo sapiens
ttggaggcggccggcgcaggggccgcgagaggcttcgtcgccgctgcagctccgggggctcccaggggagcgtgcgcggaacctccaggcccagcaggaccccggctgcggcgaggaggaaggagccagcctagcagcttctgcgcctgtggccgcgggtgtcctggaggcctctcggtgtgacgagtgggggacccgaaggctcgtgcgccacctccaggcctggacgctgccctccgtcttctgcccccaataggtgcgccggaccttcaggccctggggtgaattcagctgctcctacatcagcttccggaaccaccaaaaattcaaattgggattttccggagtaaacaagagcctagagccctttgctcaatgctggatttaatacgtatatatttttaagcgagttggttttttcccctttgatttttgatcttcgcgacagttcctcccacgcatattatcgttgttgccgtcgttttctctccccgcgtggctccttgacctgcgagggagagagaggacaccgaagccgggagctcgcagggaccatgtatcagagcttggccatggccgccaaccacgggccgccccccggtgcctacgaggcgggcggccccggcgccttcatgcacggcgcgggcgccgcgtcctcgccagtctacgtgcccacaccgcgggtgccctcctccgtgctgggcctgtcctacctccagggcggaggcgcgggctctgcgtccggaggcgcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccctggcggccgccgccgccgctgccgcggcccgggaagctgcggcctacagcagtggcggcggagcggcgggtgcgggcctggcgggccgcgagcagtacgggcgcgccggcttcgcgggctcctactccagcccctacccggcttacatggccgacgtgggcgcgtcctgggccgcagccgccgccgcctccgccggccccttcgacagcccggtcctgcacagcctgcccggccgggccaacccggccgcccgacaccccaatctcgatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaatcttccctcttccctcctcaaattcctgcacggacctgggacttggaggatagcaaagaaggaggccctgggctcccaggggccggcctcctctgcctggtaatgactccagaacaacaactgggaagaaacttgaagtcgacaatctggttaggggaagcgggtgttggattttctcagatgcctttacacgctgatgggactggagggagcccacccttcagcacgagcacactgcatctctcctgtgagttggagacttctttcccaagatgtccttgtcccctgcgttccccactgtggcctagaccgtgggttttgcattgtgtttctagcaccgaggatctgagaacaagcggagggccgggccctgggacccctgctccagcccgaatgacggcatctgtttgccatgtacctggatgcgacgggcccctggggacaggcccttgccccatccatccgcttgaggcatggcaccgccctgcatccctaataccaaatctgactccaaaattgtggggtgtgacatacaagtgactgaacacttcctggggagctacaggggcacttaacccaccacagcacagcctcatcaaaatgcagctggcaacttctcccccaggtgccttccccctgctgccggcctttgctccttcacttccaacatctctcaaaataaaaatccctcttcccgctctgagcgattcagctctgcccgcagcttgtacatgtctctcccctggcaaaacaagagctgggtagtttagccaaacggcaccccctcgagttcactgcagacccttcgttcaccgtgtcacacatagaggggttctgagtaagaacaaaacgttctgctgctcaagccagtctggcaagcactcagcccagcctcgaggtccttctggggagagtgtaagtggacagagtcctggtcagggggcaggagtgtcccaagggctggcccacctgctgtctgtctgctcctcctagcccttggtcagatggcagccagagtccctcaggacctgcagcctcgccccggcagaagtcttttgtccaggaggcaaaaagccagagattctgcaacacgaattcgaagcaaacaaacacaacacaacagaattcctggaaagaagacgactgctaagacacggcaggggggcctggagggagcctccgactctgagctgctccgggatctgccgcgttctcctctgcacattgctgtttctgcccctgatgctggagctcaaggagactccttcctctttctcagcagagctgtagctgactgtggcattactacgcctccccacacgcccagacccctcactccaaaatcctactggctgtagcagagaatacctttgaaccaagattctgttttaatcatcatttacattgttttcttccaaaggccccctcgtataccctccctaacccacaaacctgttaacattgtcttaaggtgaaatggctggaaaatcagtatttaactaataaatttatctgtattcctcttaaaaaaaaaaa

SEQ ID NO: 322 - DNA, 2595 bp, Homo sapiens
ccaccgccaccgccgtgccctgccgccctccctgcccgctggtcaagaccacgcctgggaggatgtaccagagcctggcgctggccgcgagcccccgccaggccgcctacgccgactcgggctccttcctgcacgctccgggcgccggctctccgatgtttgtgccgccggcgcgcgtcccctcgatgctgtcctacctgtccgggtgtgagccgagcccgcagccccccgagctcgctgcgcgccccggctgggcgcagacagccaccgcggattcgtcggccttcggcccgggcagtccgcaccccccagccgcgcacccgcccggggccaccgccttccctttcgcgcacagcccctcggggcccggcagcggcggcagcgcggggggccgagacggcagtgcctaccagggcgcgctgttgcctcgagaacagttcgcggccccgcttgggcggccggtggggacctcgtactccgccacctacccggcctacgtgagccccgacgtggcccagtcctggactgccgggcccttcgatggcagcgtcctgcacggcctcccaggccgcaggcccaccttcgtgtccgacttcttggaggagttcccgggtgagggtcgtgagtgtgtcaactgcggggccctgtccacaccgctgtggcgccgagacggcaccggccactacctgtgcaatgcctgcggcctctaccacaagatgaatggcgtcaaccggccgctcgttcggcctcagaagcgcctgtcctcgtcccgccgcgccggcctctgctgcaccaactgccacacgaccaacaccacgctgtggcggcggaactcggagggggagcccgtgtgcaatgcctgcggcctctacatgaagctgcacggggtgccgcggcctctggctatgaagaaggaaagcatccagacacggaagcggaagccaaagaccatcgccaaggccaggggctcctcaggatccacaaggaatgcctcggcctccccatctgctgtcgccagcactgacagctcagcagccacttcgaaagccaagcccagcctggcgtccccagtgtgccctgggcccagcatggccccccaggcctctggccaggaggatgactctcttgcccccggccacttggagttcaagttcgagcctgaggactttgccttcccctccacggccccaagcccccaggctggcctcaggggggctctgcgccaagaggcctggtgtgcgctggccttggcctaggtccccaggccagcccatgtcaggggaacagcctggaacagaccacccactgagtcacctccgtgcctgctttgctccagcacagcagagaccagcaggccccccaacccagagactgggtctgctggagtctccacacagtggtggggaggccttctggacagacggcagtcgggccccagagcaagaaggctggtgagggaagggctcagcttcccaccccacgtacagcaagggactccccaggtgcggcccaaggctccggaccacactggccccctgcggcggaggccaacgcagggcaccaccaccaccaacttgaattccgtcatcaatgctcaccgtcaatatgtttacaagttgtagcagttgggggaaaacagtcaacctcccagtgtaaaaccaagattcccagtgaagcacctgaggccaagcaggggagaggaatgaggggagcagctggacatgggcctcctgaggcctcggggctgtccttcattgcccacatggatagacggagctgtggtgcagagaacttttcccgcaacaggtgcaggactgccagggatcggagtgcgggccgcgcacggtgccaggattccgccgaggggaagccgctcacattgcagtcatcacagacttacgcacttgtttggacagtttttccagaggggatgggaaagggccttgttctagctgaatctgtgtatcatgaccatttctgacaggcagaatgaattgtctggtagccctgtcctgacccatccaagcgctgttggggctggtggtgacgtggtcacatgtcctggcatatctggggccacgcagtttagtctcttgtcccaggagaattgttagtgacccctctttctcttgcaagccccctccacactgggttggatgataccttaatgagtgacgctggcgagaggcaccctacccgacgcagctgtgaatggccggtgatgtatgtcaggaggccacagggagcagaggagcggggcaggcagccacagggccctgcggggagcacatcctcgcctccgtccggctgctgcccttcaacaacaagccctgatttttccagcaatgccagaaacctggattttaagtcttccaatttgattcaaaaatatttttaacattgtgagccagctagacccccagtgcaccaccccatattgaaaaacagttgtctggcatcagcttcaggagcgggtccggtcattctgaaactgtccctccagaggttcttccagccccacttctatgcgatgtcatcttttctaaaagagacaaatgaagccacagggaaagtgaaataaagccttgaacctca

SEQ ID NO: 323 - DNA, 3494 bp, Homo sapiens
ggcacccttcggcgagcgctgtttgtttagggctcggtgagtccaatcaggagcccaggctgcagttttccggcagagcagtaagaggcgcctcctctctcctttttattcaccagcagcgcggcgcagaccccggactcgcgctcgcccgctggcgccctcggcttctctccgcgcctgggagcaccctccgccgcggccgttctccatgcgcagcgcccgcccgaggagctagacgtcagcttggagcggcgccggaccgtggatggccttgactgacggcggctggtgcttgccgaagcgcttcggggccgcgggtgcggacgccagcgactccagagcctttccagcgcgggagccctccacgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggaggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtgccttcatcacggcggcttggattgtcctgtgccaactgtcacaccacaactaccaccttatggcgcagaaacgccgagggtgaacccgtgtgcaatgcttgtggactctacatgaaactccatggggtgcccagaccacttgctatgaaaaaagagggaattcaaaccaggaaacgaaaacctaagaacataaataaatcaaagacttgctctggtaatagcaataattccattcccatgactccaacttccacctcttctaactcagatgattgcagcaaaaatacttcccccacaacacaacctacagcctcaggggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcggtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaatttttttttttgaatgggatgtcctatggaaacctatttcaccagagttttaaaaataaaaagggtattgttttgtcttctgtacagtgagttccttcccttttcaaagctttctttttatgctgtatgtgactatagatattcatataaaacaagtgcacgtgaagtttgcaaaatgctttaaggccttcctttcaaagcatagtccttttggagccgttttgtaccttttataccttggcttatttgaagttgacacatggggttagttactactctccatgtgcattggggacagtttttataagtgggaaggactcagtattattatatttgagatgataagcattttgtttgggaacaatg

SEQ ID NO: 324 - DNA, 1348 bp, Homo sapiens
attcgcactagtccagctgctctgaggtgtatatcatcgcgtactgcctgtctctagtcgagaagctggagtgtggtgcgaatgagatgggggtggtgggaagttgaggggatcattgtccacacacttattgcctcccagagttttccgtagtgaaatctgtgctggttaatacctttcttcccatttctttgttttccctaaacctcttcccattccatatcctggacataccatccttctgcctcctgtccctccccatcttctcctctccatggctactcttttttcctgctcttgtctcccaaccccccatttctggcatggttccatgggcctccattggctctcaactctctttctgctctcctcccatcatgcttcttgctcctcacagcagaggaagtgtacagccatagatgaggagaagctgaggcatcagcagagcccagcaggcagcgacaggaggagagggactcaggcgtgacagcggatgacggtttccctggacagttctgcagggggcccaggggctcttctgggacctaaaccgaagctaaagggaagcctggggactggagctgaggagggggcaccggtgacagcaggggtcacagctcctggggggaaaagccgacggcgccgcacagcatttaccagcgagcagcttttggaattggagaaggaatttcattgtaagaaatacctgagcttgacagagcgctctcagatcgcccacgccctcaagctcagtgaggtgcaggtcaagatctggtttcagaatcgacgggccaagtggaagcgcatcaaagctggcaatgtgagcagccgttctggggagcccgtaagaaaccccaagattgttgtccccatacctgtgcatgtcaacaggtttgctgtgcggagccagcaccaacaaatggagcagggggcccggccctgaatgggcacccaagaacttaggaaggcgagggatctgtacctgagcctgctctgagactgtcagggttctgtggaccagaggggctgcaactgtgattctgccttgagaggggctagttgggaattaacctagccctgggtgtgctcttcccagactcatcaagaacctgagatgtgaagcacttgggcctgagcctgttccagagacctcaggactagggcctcaaggttaaagggggctggggttctattgctgagggagctgttgggactgaggtggactcctggggagggggtgggttctaagatgcctaagggcctgaaggttctgtggcaaatgccctggaaccagcttctgatgggtggagggaacaggcgatacctagccaagtagatcgcagctcct

SEQ ID NO: 325 - DNA, 1335 bp, Homo sapiens
gacttttcgcctctcgctggcctctaccgagcgcgtctatgagcgcagcgttcccgccgtcgctgatgatgatgcagcgcccgctggggagtagcaccgccttcagcatagactcgctgatcggcagcccgccgcagcccagccccggccatttcgtctacaccggctaccccatgttcatgccctaccggccggtagtgctgccgccgccgccgccgccgccgcccgcgctgccccaggccgcgctgcagccagcgctgccgcccgcacaccctcaccaccagatccccagcctgcccacaggcttctgctccagcctggcgcagggcatggcgctcacctctacgctcatggccacgctccccggcggcttctccgcgtcgccccagcaccaggaggcggcagcggcccgcaagttcgcgccgcagccgctgcccggcggcggtaacttcgacaaggcggaggcgctgcaggctgacgcggaggacggcaaaggcttcctggccaaagagggctcgctgctcgccttctccgcggccgagacggtgcaggcttcgctcgtcggggctgtccgagggcaagggaaagacgagtcaaaggtggaagacgacccgaagggcaaggaggagagcttctcgctggagagcgatgtggactacagctcggatgacaatctgactggccaggcagctcacaaggaggaagacccgggccacgcgctggaggagaccccgccgagcagcggcgccgcgggcagcaccacgtctacgggcaagaaccggcggcggcggactgccttcaccagcgagcagctgctggagctagagaaggagttccactgcaaaaagtacctctccttgaccgagcgctcgcagatcgcccacgccctcaaactcagcgaggtgcaggtgaaaatctggttccagaaccgacgggccaagtggaaacgggtgaaggcaggcaatgccaattccaagacaggggagccctcccggaaccctaagatcgtcgtccccatccctgtccacgtcagcaggttcgctatcagaagtcagcatcagcagctagaacaggcccggccctgagggtccagaagggccagggcctggcacccacctggagaagcccccgcacccgagggaacccatggtggactccactgtgtttgaagcaacaaagtcacagcccagctgtggccatcccaagcaaattgagaatatattcactaaatgggcttaaaagactgcttttgaaggggcttacagccacaccagaagacacgctaaatatttattatactatcctactttgtacataaatatctctatagactgg

SEQ ID NO: 326 - DNA, 2802 bp, Homo sapiens
gagggtgcgcccaccggtcccgccgggcgcccgcgggacgcgccgccagggccctctccgccgggggctcggcgctcgcccacctcttccaaatttaaccattacctaaatccgaagggaaatgagcaaacctctcggattgggtgtcaaggtctcctccgggctggggctgagcaagccctcggagtgaccgtgggtgacagcggctccagggactcttggggcgcagtggggaaagtgccggaccaccatgccgcgctcatttctcgtcaaaagcaagaaggctcacagctaccaccagccgcgctccccaggaccagactattccctccgtttagagaatgtaccggcgcctagccgagcagacagcacttcaaatgcaggcggggcgaaggcggagccccgggaccgtttgtcccccgaatcgcagctgaccgaagccccagacagagcctccgcatccccagacagctgcgaaggcagcgtctgcgaacggagctcggagtttgaggacttctggaggcccccgtcaccctccgcgtctccagcctcggagaagtcaatgtgcccatcgctggacgaagcccagcccttccccctgcctttcaaaccgtactcatggagcggcctggcgggttctgacctgcggcacctggtgcagagctaccgaccgtgtggggccctggagcgtggcgctggcctgggcctcttctgcgaacccgccccggagcctggccacccggccgcgctgtacggcccgaagcgggctgccggcggcgcgggggccggggcgccagggagctgcagcgcaggggccggtgccaccgctggccctggcctagggctctacggcgacttcgggtctgcggcagccgggctgtatgagaggcccacggcagcggcgggcttgctgtaccccgagcgtggccacgggctgcacgcagacaagggcgctggcgtcaaggtggagtcggagctgctgtgcacccgcctgctgctgggcggcggctcctacaagtgcatcaagtgcagcaaggtgttctccacgccgcacgggctcgaggtgcacgtgcgcaggtcccacagcggtaccagaccctttgcctgcgagatgtgcggcaagaccttcgggcacgcggtgagcctggagcagcacaaagccgtgcactcgcaggaacggagctttgactgtaagatctgtgggaagagcttcaagaggtcatccacactgtccacacacctgcttatccactcagacactcggccctacccctgtcagtactgtggcaagaggttccaccagaagtcagacatgaagaaacacactttcatccacactggtgagaagcctcacaagtgccaggtgtgcggcaaggcattcagccagagctccaacctcatcacccacagccgcaaacacacaggcttcaagcccttcggctgcgacctctgtgggaagggtttccagaggaaggtggacctccgaaggcaccgggagacgcagcatgggctcaaatgagcaccctggctggctgcaagcagcagctacacaacactacagagggcagcctccctgcttgccaccactctgctccctgcttgcctccactcccttctgactttccagaccccaggtccagtctgcagatcctaccaggttgctcctccttcgccttacctcctggagctgccagaagaaatgaggtaccttttcaaagtgcagccgagagtgagaaccaagtgactctctaggcttcggacacaaataggctcctctacacctgaagacaaaggcaaagtcaaatggggaccagaataaatcttagaccccacagtccttcccatttccagccctaatctacagacaggaatgcccttcaggtttcttccctcccccctcttgacctaccccagatatttgtgtggaagaggaggaatcaccatttacaaggtggacaaatgctaatatttttatctagaaagaagagtgagtgttaacttttatttttttccttctggggggtctgttgactcctttcttttgggtgctgcctataaatcttggaggaatcatttctcctcctcaaaaactgattcagaaactgacttggggaaggaatttaatactttgaagtcatgagatgcaccatcgaggctacccccaagaagaagcagaagagaagttggtaatgagaggggattagaggtcctcccttcagtagggctgtgaaaacctcatcactggaggtaaaagcacaagcaatgcctgtggacaagatgtcattcattcactcagcaaatgttcatggatcaccggctaccaaggtaccaggcaccatgctaggtattggggaagagagactgaagtcacaacccctgactgctcctcaaaagctaacggttgcacctccaagtggctgggtctgttcttactcttggagggaattctgagaagacagcacagaattgtaaaccttcccttttgacccttttggattttatcaggtgtaaacaaaaagctgaacagttacttcaaagatatgtgtgtatattcagttttttattgttaagctgatattttaaagatttctgagctagcaggcatgtgggaaggaaggctctgtcttcaactctttgaccctccatgtgtaccatagaggggggaaaggtggtattttcactttgatgaggttggtaaatgtttttagatcttctggtaagcattatgtttgttaatacatatttattagagtgatgttttaagttaataaagtattaagagtattaaaaaaaaaaaaaaaa

SEQ ID NO: 327 - DNA, 1801 bp, Homo sapiens
aaaaaggagaagtatctatttgtgcaaagagtcacacagttgacagagtggaggccagtcccgagagaggctttgcagttcccacctcgggaagctccggcagaacccaggcgagggacagctccggacaggtgtggggtgcacactgaaaatgccacgctccttcctggtgaagagcaagaaggctcacacctaccaccagccccgtgtgcaggaagatgaaccgctctggcctcctgcccttaccccggtgcccagagaccaggctccaagcaacagccctgtccttagcactctattcccaaaccagtgcctggactggaccaacctcaaacgagagccggagctggagcaggaccagaacttggccaggatggccccggcaccagagggccccattgtgctgtcccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggtcttctccacccctcacgggctcgaagtgcatgtgcgacgctcccatagtgggacccggcccttcgcctgtgacatctgcggcaaaaccttcggccacgctgtgagcctggagcagcacacgcacgtccactcccaggagcgcagcttcgagtgccgcatgtgcggcaaggccttcaagcgctcgtccacgctgtccacccacctgctcatccactcagacacgcggccctacccctgccagttctgcggcaagcgtttccaccagaagtccgacatgaagaagcacacctacatccacacaggtgagaagccgcacaagtgccaggtgtgcggaaaggccttcagccagagctccaacctcatcacccacagccgcaagcacacaggcttcaagcccttcagctgtgagctgtgcaccaaaggcttccagcgcaaggtggacctgcggcggcaccgcgagagccagcacaatctcaagtgaggctgcgccggctcccagctcctggccagcctgccctgcggtcctgtcacctggaggccagcctcacatgcccaaatctccagtctcctggaggtgggactggacaggagtctaccagcttgttttgagactcatgaaattgctgtgtgaccttgggcaagtcacttaccctgtctggatcaacatttctcctgctgccaagtgtgggagcctggctgggtctttctcagcagaagttgtttccaggtgtgctcaagtgccttcctctagcagagcacagaaagctagaatacccccagggagacagggatgccaagagtagaccagagctgggacccacagacagaacctccacctgcctgctgcccactgagctgggacctggtcaccttggattttagccggcctctttctggctataacaggcagagtcggagctgcctcccaccccagtcagaagcctggcaccccctctgcttcggccagatgtgctggctgactccgacttccgaccagcactcagctggcctctggggattctagctccacaaccaggccgtgaggctggagaaactggcagttattgctgtcaaaagcctgttctctcaactgctgtcaataaaattaaagatacagatttgctgccaaaaaaaaaaa

SEQ ID NO: 328 - DNA, 2237 bp, Homo sapiens
tcaaatgcaatgagtgtaaagaatgttggaaggcctttgttcattgctcacaacttaaacatctaagaattcataatggtgaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctggaaagaaaccttatcaatgcgggaaggcgtttaatcatagattacaacttaacttacatcagactcttcatactggcgagaagccagtcaggtttcctctcctccctccccatcctagtctagcatcatgaaatttgttgatggaaatatacattgtctttgttttatttaaggaaaaagttggtaagccaccagtttcattagtatttatttatttaaataatccttgaaaatcaaatgtttttaagtgagaaagtggataactaaagtgtaaattttggtctcattttaatgctgtttctgagttattgtattaaccattattgagaataaatttttttattgagaataaattttctaaaattacatgtttcactgaaaccagtgaaatatttcactgaaacagtgaaataaaatgaaaacaatttcctcccttccctcaaatctctgagataaccagtatgtgtatttcttcttcctttatgctcaaacaacctgtacacagaaagcattttttgcatgtgtttggaggagcttttacccccatacagacatttgacagcgtcttgtccttttcataataatcatgaatacttttccaggtcagtacgtaaagatgtaacccattctttgtaaggttcagaatatttctagaatggaatgtatgtccgtattttgggccattacctactacagacattgaagttgtttctaatgttcacctagaactctaattttaccttcttttgtttctattgtgcagattcccaacagtgggattaaagagtatctggcgtatatattttgacattacatttattttttaaaatcttctaaattttttgtttaataaaagcacacattataaaaattcaaaaattaccaaaaatgtgaaaattaattctcccctaacatccagttctgtagccactcactttccacagatgcaacaactgctatcagtttccttttattctaacgggaatatttcatgtaaatttcataaattctttggacaaaagtaggttattcataatatgtgatttattacacattctcattattagtccacatttggcctacttcattttttttttttttgagacacacccaggctggagtccagtggtgcaatcttggctcactgcaacctccgccacccaggttaaaaattctcctgcctcagcctcctgagtggctgggactacaggcatgcgcagccactatgcccggccaataagctatatttattcttatttgatgtggatgaaaattatcaaaattggccgggcttggtggctcatgcctgtaatcccagcactttgggaggccgaggcgggcggatcacgaggtcaggagatcgagaccatcctggctaacatggtgaaaccccgtctctacta

SEQ ID NO: 329 - DNA, 2674 bp, Homo sapiens
cgggttcctgagaattgtcaatcaggcgcgaggcagagaggagggtgtgacgttccaggagctagtggcctcttcaccctggtgacctctgttccgtattctgtcactgagagacgccctgggacatctgtggtggcttttgtcgcgctgggacctaccctgactacgggagttgggaggacccgggacaccgcacagccgggaaatggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaaggtgtgatgtggtagagagatttggtaaaagtaaagatggtagtcagtgtggagaaaccttaagccagattcgaaatagtattgtaaacaagaacactcccgccagagtagatgcatgtggaagcagtgtgaatggagaagtcataatgggtcattcatccctgaattgctacatcagagttgatactggacacaaacaccgggagtgtcatgaatatgcagagaagtcatatacacataagcagtgtgggaaaggcttaagttatcgccactcctttcaaacatgtgaaaggcctcacactggaaagaaaccctatgattgtaaggaatgtggaaaaaccttcagttctcctggaaaccttcgaagacatatggtagtaaaaggtggagatggaccttataaatgtgaattgtgtgggaaagcctttttttggcccagtttattacgtatgcatgaaagaactcacactggagagaaaccatatgaatgtaagcagtgttctaaagccttccctgtttacagttcctatctaagacatgaaaaaatacacactggggagaaaccgtatgaatgtaagcagtgttctaaagccttccctgattacagttcatatctaagacatgaaagaactcacactggagagaaaccctacaaatgtaaacaatgtgggaaagccttcagtgtttccggttcccttcgagtacatgaaagaattcacactggagagaaaccctatacatgtaaacagtgtgggaaagcgttttgtcatcttggaagctttcaaagacacatgataatgcacagtggagatggacctcataaatgtaagatatgtgggaaaggctttgattttcctggttcagcacgaattcatgaaggaactcacactctagagaaaccctatgaatgtaagcaatgtgggaaattgttatctcatcgctcaagctttcgaagacacatgatggcacacactggagatggccctcataaatgcacagtatgtgggaaagcctttgattctcctagtgtatttcaaagacatgaaaggactcacactggagagaaaccctatgaatgcaagcaatgtgggaaagccttccgtacttccagttcccttcgaaaacatgaaacaacacacactggagagcaaccctataaatgtaaatgtggaaaagcttttagtgatttattttcctttcaaagtcatgaaacaacacacagtgaagaggagccttatgaatgtaaggagtgtgggaaagcatttagttcttttaaatacttttgtcgccatgaaaggactcacagtgaagaaaaatcttatgagtgtcaaatttgtggcaaagccttcagtcgtttcagttacttaaaaactcatgaaaggactcacacggcagagaagccatatgaatgtaagcaatgcaggaaagcattcttttggccctctttccttctaagacatgaaaggactcacactggagaaagaccctatgaatgtaaacactgtggtaaagccttcagtcgttccagtttctgtcgagaacatgaaagaactcacactggagagaagccctatgaatgtaaggaatgtgggaaagccttcagttctctcagttcctttaatagacataaaaggacacactggaaggatattctataagtgtatggaatgtgggaaagcattcattggttttatcacattcagatacttgaaagaaataaatcctgtgaatgtaaacgtggtaaagccttaagaagtttccaggctgggcgcagcggctcacacctgtaatcccagcactttgagaggccgaggagggcagatcacgaggccaggagatcgagaccagcctggctaacatgggaaaccctgtctctactaaaaatacggaaaaaaaaaaaaatagccaggcatagttgctcacacctgtagtcctagctactcaggaggctgaggcaggagaatcccttgaacccgggaggtggaggttgcagtgagccgagattgcactactgcactccagcttgggtgctagagcgagactccatctcaaaaaaaaaaaaaaaagtttccatttctttcaaatagagttgctgcctgctatatgcaagaagattggttccagtacaccctgagtatacctaaatccacagatgccagctcttttataaaatggaatattcgcatgtacctacccacattctcctgtatactctataaatgtctagattaattaaaatatctcatgcattgtaaaaaaaaaaaaaaaaaaaaaaaaaa

SEQ ID NO: 330 - DNA, 3618 bp, Homo sapiens
cccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacagaaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccatgcacaagatgccccagggatgggaggtatgggctgggggctatgtatagtctgtatacgttttgaggagaaatttgataatgacactgtttcctgataataaaggaactgcatcagaaaaaaaaaaaaaaaaaa

SEQ ID NO: 331 - DNA, 6780 bp, Homo sapiens
gattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacgggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatgtggcccaggagcaccttaaggagaggggactgtttggccttcctgctccaggcaccaccccctcagactattaccaccagatgaccctcgtggcaggccaccccgcgccctacggggacctgctgatgcagagcgggggcgctgccagcgcaccccatctccacgactacctcaaccccgtggacgtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagacgccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccgattcagccctggctggagtgccaccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccagaaaaaggaaagaaaaaatgtactccttggggcaagcccagaagctgccctggcctctccagaccgtgtttacagtgtttgcatgtagaatgtagcccttcctgaaaagaagacttgtttctaaatacctcggggctgctggagccgctgtgggttagggatggactgaggcctcgaggagtgagggtgcacccggggcccagcctcaggctgccctagggatctctcagtaggaagaggaagttgcgtgtttacccaatcctgtttctccaatgcaacgtccacccactttaccaccaaaaactccagggcctgacggcagcccggtcccccagcactcaccagcagcccagtgttctccaccaagccacagtgtgcatgcctggtatcctccggattcccttccttctgcccgctgagtcactgggcagagaatgatgacatgtgtaggtggtgtggttgggggtggaaaggggaaggggttgatcctcaggactctgagggagcatcgttgaattttcctgttcagtgtgaccaagacccacctggaaatggaatttggaactggcttcaggagacatcattcctgaacacactgtagggtgaattggtgcatcttccccaccatacacacacacacacacacacacacacacacacacacacacacaccccaaaccttttcatggggaatgtgtggcaaccttgccaaacagcaccactcagagtgtgactctgactgtgaccttggccttaatgaggaacttcttaggagagtttgaggacaaggccaacatcgtcatctgggctcgctgcgtcccagcacatcaaactctgtccagagacaaggccaactgcaaatgaaagccagggaacattgctaagggtctgtggctctgtggtggtgttcatcgccttcctgagataggatttcccttgccagtcccaacctgtatatattctgtacagaagacatccctgaatatactgtaggtgagtcgtccagccaaatttatatctccaaaacatttttagctttttctacatgctatgaattgagatgacatgctcaacttgtaaataagtctttttgtacattaaaaaagtaattttttcataatttatcttgtctatctgcttcccccttgacagtagttaatgagaacctgggcagtaaatttggtgcattcgagcagaaattaggctgtattttttcttaacagtgtcaaaattgactatcccgcctttgccaagaaatgtttaatgctgaggcaaaaaaaaaaaa

SEQ ID NO: 332 - DNA, 8228 bp, Homo sapiens
ccgcgggtctatgggaagttcggggacttgacagccgctgccgccgcagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatgaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccggaaccccactgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgccgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaaaaaaaaaactgtaagccccgccccctttttagtaaaccgatgtaaatttgtgatgtgcatattcttctttcttttagaagagcagtcaaattaaaggatttgacatgttttgctgttgctcaaaggaaataggagttggtgtgcttgtgaccaaggggttacacttccagcttttaaaattctcctttacatgtgctcagtgttttgttttgtgttttggtttctgttttttattttaattcccacattgggcacaagaatcagaatatggatagctagtttaagaaacttttgtgggtgcactgtagcatagatgacagaatattgatgttccccccatctccaattcagttcagggcattccacagttaaacagaaatgggaacgtggggctcttataaatgaaatgggcgctcacagttttggttttcagctcttcatgtctgtaagtgtgctttgggggaggctatgtctgtatggtcgattctcagttatcacatttgcctctcctcccactaccttcatgaacattcagtgctgtttcgcactgcagttagagagaagggacggacagttggtgacactcagccacattgctacttttatctgttctggtaagaagttagatagatggtagattgaagcaattgggtagaattagttgggggaatatttatgagttgctgtgtttgttgattagttccatctctttcccattttaactgagaattgattatatatagctctaagtatataggtatttaaacaaccccacaagcggctgtatcagtaacatttattaattccactatagtgagggaggatttccattctaaataccttattttgagggatttataaaacttagttgtaaaagagaaagcccacatagtgggaataaattgcttcagccatttttagtatttgagagcactagggaagatgtttagtagctgtgtggatgccttttttcacaccctgtctattgaatgctgcatccattcacgaagttaaatgttacatgcagttagtccttaatgtggactggatctgtacttttgttttggattaaaacatttaaagatttttgaagtgcagctactccccacgtgcatttgatacacataaaagtcatactgtgtgtgcacaaagagtacatggattttccagcatattgctttaaaaaattatataaactgttaaaatattaacacctcaggctacctgctgtattctgtcccattgacccctggaattggatttactgcaagtgattgataattcaattatgtggcttttcccctttaatcttgccatttaaattacagtagaaagacaaaatcaagtaaaataaagtgttagataatagaaagagtgttaagaccagcccacttttctcatgtttatgttctttcatttggaccaagaatctccgcatggaggttgatttgccactggggactttggctaagactattaggtttgctttcaactagatgttcctgagacaagcagagggacactgcaattccccttccatgcctgctgttctcccccatgtaagtcttctttgaaattaacggatgtgtctcctttggaacagccccataacaaaagagaactactgatctgagcataggaaagtagaggctctaccacttttcagttgaaaaagcaagactttctctgtgtttctgaaacaaggcataatgttgtcacagaatcagagatccagtctcacttttccacaaatctccaaatctccagtcttatcttgtgtgctctaatggtttggttcaatccctttccaactcttgttttcaaagcatggggcctgagtgttctccactcctcctaagaaaggagcttgggtggaagggaccatgctgacctcctccatcagagggctcttccagtagtattctcggatgcaacctccatttctcagttaccattatttcctgtatcagctttgtccttcctggagggatgcacagtgatccggcccaccactgttgttgtcttgtgcttctgctctttcctatggtttcaggttattttctgggtttcccctattcttcttttatttctttttttttttatatttgctttcctttctactgcttttagatttgcaggagatgcaagtttcagctcaatgtttggcttctctcaatatggaaatttcagaaggacagaggagaggagggaggaagaagaaagtatactcctccagaatttcagtgatctgttgtggcagtccagtggaaggaaggtcttttgaggtcacttagaagcatctttttgggacatccttttgggatctctgtaggctaggcatctcatatcttgagactcacccccagcctccaagcctctctccatttctctaacctatgcattttagagcgagaggaccgcctcactagtgtcaccatcctgccttttctaaaacatgcaggctcacacattctactcctgcttaatgtctgtgttaaacgttttctaaccatttttgttttatttttctgaaaaagttaacccctcccaactcctcacacattggctcttcctcttgagccacaaagttttgattcttgcgatgtatgtgccttattttatgttaatcttgtcaatgagagggaccagttggtgttgcccaatcagcactccaaggctgtgtgtgcaccagccagagagcgcacggtggtagcagagtcgaggctgtcttgtatcctggtttcatgtgttgttttgaactgataggaggatgttctcttctgacaagttacccttgtgtatcctgcagacatgtaaaataaaatacaagttcatttttttcaccttttttagatttttttaaaaaataaaatgtgtaatcctttttttaaaagaaacacatgtaaatacatttaagtattgtaggcatagcgttcagatgtgactggcccaggcgttcctcggacaagcctgcattccccgtgatcacgcccacctcaagcccaggggctgcagcccagccacagatgaactctacctttgctttcagaaccacttagtccttttgtaacaaagaaaaaaaaatgtttcttacaatgtcaataaaaaattctttgtatggaaaaaaaaaaaaaaaa

SEQ ID NO: 333 - DNA, 1363 bp, Homo sapiens
ggccggacacttccgtccggcgcgcggcgtcctcctcccgctcggaaggtcccaggtgtgacaccttcagcaggtctcagggaagatggcagccctaggggacattcaggagtccccttctgtcccgtcccctgtcagtctctcatcaccggggacacctggaacccagcaccacgagcctcagcttcacctccatgggcatcaacatggctcccctggctccagccctaaggtgctctcccagccgtccgacctggatctccaagacgtagaggaagtggagatcggcagagacaccttctggcccgactccgagcccaagccggagcaggctccacgctctcctggctctcaggcccctgacgagggggcgggcggggcgctgcgcagcctcctgaggagccttccccgcagggcccggtgcagcgccggcttcgggcctgaatccagcgcggagcggccggcgggccagccgcctggggccgtcccttgcgcccagccgcggggcgcctggcgcgtgacgctcgtgcagcaagcagcggccgggcccgagggtgcgcccgagcgggctgccgagctgggagtcaacttcggtcggagccggcagggcagcgcgcggggggccaagccgcacaggtgcgaggcctgcggcaagagtttcaagtataactcgctgctcctgaagcaccagcgcatccacacgggcgagaagccctacgcctgccacgagtgcggcaagcgcttccgcggctggtcgggcttcatccagcaccaccgcatccacacgggcgagaagccctacgagtgcggccagtgcggccgcgccttcagccacagctcgcacttcacgcagcacctgcgcatccacaacggcgagaagccctacaagtgcggcgagtgcggccaggccttcagccagagctccaacctggtgcgccaccagcggctgcacacgggtgagaagccctacgcctgcagccagtgcggcaaggccttcatctggagctccgtgctcatcgagcaccagcgcatccacactggcgagaagccctacgagtgctccgactgcggcaaagccttccgcggccgctcgcacttcttccggcacctgcggacccacacgggcgagaagcccttcgcgtgtggcgcctgcggcaaggccttcggccagagctcccagctcatccagcaccagcgggtgcactaccgcgagtagccgggcgggggctcggggctcggcctcctacctgcccccaacccaccctccaccccgtcccccacggtgggcactgcccagcaccgcatgccacgtgtccggaataaattctttttgattgttggaaaaaaaaaaaaaaaaaaaaaa

SEQ ID NO: 334 - DNA, 3705 bp, Homo sapiens
tgaagaccagctgggagcccactgcctgctgccacctccaactccggccccctcaccatgcactccctggacgagccgctcgacctgaagctgagtatcaccaagctccgggcggcaagagagaagcgggagaggacgctgggtgtggtccggccccgtgctctgcacagggagctgggcctggtggatgacagccccacacctggctctccaggctccccgccctcaggcttcctgctgaactccaagttccccgagaaggtggagggacgcttttcagcagcccctctcgtggacctcagcctgtcaccaccatctgggctggactcccccaatggcagcagctcgctgtcccccgagcgccagggcaacggggacctgcctccagtgcccagtgcctcggacttccagccactgcgctatttggatggtgtccccagctccttccagttcttcctgcccctcggctccgggggggccctgcacctgcctgcctcctccttccttacccctcccaaggacaagtgcctctcgccagacctgcccctgcccaagcagctggtgtgtcgctgggccaagtgtaaccagctctttgagctcctgcaagacctggtggaccatgtcaacgattaccatgtcaagcccgagaaggatgcggggtactgctgccactgggagggctgcgcccgccatggccgaggtttcaacgccaggtacaagatgctcatccacatccgcacacacaccaacgagaagccacaccgctgtccgacctgcagcaagagcttctcccgcctggagaacctgaagatccacaaccggtcgcacacaggtgagaagccctacgtctgcccctacgagggctgcaacaagcgctattccaactccagtgaccgctttaagcacacgcgcacccactatgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactgcccgcccccgacggcggcccctatgtcagtggggcccagatcatcatccccaacccagctgccctctttggaggccctggcctgcccggcttacccctacccctggcccccggcccccttgacctcagtgccctggcctgtggcaacggtgggggcagtgggggtggggggggcatgggccctgggctgccaggccccgtcctgcctctcaatctggccaagaacccgctgctgccctcgccctttggggctggcggactgggcttgcctgtggtctccctccttgctggcgcagctggtggcaaggccgagggggagaaggggcgtgggtcggtgcccaccagggccctgggcatggagggccacaagacgccccttgaaaggacggagagcagctgctcccggccaagccccgatggactccccctgctgccaggcaccgtgctggacctgtccacgggcgtcaactcagctgccagcagcccagaggcgttggcccctggctgggtggtcatcccgccgggctcggtgctgctcaaaccggctgtggtgaactgagcccatcctgcggacagttgtggtgcccccccggcagctcccggcactgcccccgacgaacggaaactcttctgtgaaatagcaataatgtcctactgcccgggcagccccagcccagcccgccgggagcaaggatggtgctaggtcattcatggctggcctcccagcccccgggtggggacctggcctgtcatgcagggagagctgtgctcctgggtgctgaagcctcgctcctgtctgtcccccaccacctggccctcagcttctgagaggctttcccctgcccgacctcctcccgtttccctctcccaccctggcacctccctcacctagtgaccacccatggcaagttgccctctcccagcagagggggtgggtggggtggcatctgccctccctgctagcaccaggctcccccttcctgagaggagcccccagggaccagaggcctgcccttccctcctaggcttacccagcccctgccctgggggctccttggacccctttccctctgaccctgcctccagagggaaagcaagacagatgcaggcccctgcaaagccccaggtagaagcatgccccccaggacaaggcgcctcccactagttaggaggaggcccgctctgcagccgccgtcctcaccccaggccaggcctgcagtaccagacgggatagctggccactccacccctgcaccccagggtctcctccctctaccttttggggcaccctgggagcgtgggaagcaggtccgagggcccctgagctggcaaggggaggtgccaggccagctgtggtgccaagatactgagtgacctgggccctggctcagggagcatgtggggccaggcccagcgccccgtcttcctccttctacccccgctgggcctggcctgggcagcgccccctgcagaggcctttgggtccttggtcctgtaacaggaagggggaggctggctggggacgaccgaccacaggctgggacacagctcctggtctgggggctccaagtgacagcatgcaggggagggggctcccagtcagtgctgtgttgggagctttctggaggctgtggactgaaggccttgagggaagcagtggctggaggagggtgctggacccatgacacgttgcttcctctggcttttccctgctgggccgctttctcagaggcacttccccacccctaacacccagtgggcccccccaggttctgtgccactcagagggaccctggcaggggccagaaccacttaagggtggtgctggagggccttgtgccccagtcccatcccaggacgccctgagggatggacgcagccatgcaccccccatctggggcctctccctgctccctctcccacctggcagctgggagttctggcttctaggcctgccctgtcaccaggcctctgagtggccaggcccttccacctccccatctgtaaaacgaggcagctgcccggacagccttggggtccttagtggccctgcaggtcctctggcagctctgctgaccccaccctctcccggactgcccttctgtcccagaggggtcaccctgacccggcccaccttgccactgggctttggactccagccctgacagggcccagccacactggctctgcccctcgaaggggctatgagcaaggtaggagggagctggtctcctttcttcgggccccacccaggccctgagcaccccccacccctgtgagggccccaggccttaagtccctggcggggtcatgggtttgcgacttgagcagagcggaggaacagggcactggaaggccgacgagctcagcatgcgactcggtgacggaccaggctcggcagggccggtgtactttttgtggttgtcattggtgtgttgttgcacattccaggacgtcagtattttaacaggttctaagtgcctttctatcgtagcttatgttttcctcctcttggctccattgctgttagcatagagttttaaaaaaagagataagctaatgactataacaatatattcctccatgggagaggaagtttataaagaaacaataaaagtgagttgcaaagatg

SEQ ID NO: 335 - DNA, 8482 bp, Homo sapiens
aaataaagttttttcaatggaaggcttgcagctcttgaggacctgccaaatggaagaaggacagagacctggagccctatggaaagttctgacaccatgtgtggaaggacatggcttttaacacgtgtggtgactggagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccatgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaattgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgacctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatg

SEQ ID NO: 336 - DNA, 8904 bp, Homo sapiens
atgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagcattacaaaagctccaagcagagcgtgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatgagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctcccagcttcaagccgaacacacgctgtgagccaccaagacctggggcgacaggagaaccggtcctctctctgacggggtggcatttggccttgaacaaaaccaagtccactggggacagaggcaggggcaagtggctctccccattaccttctcaagacctcagtgggagcaccagccaatggtaccatcggctgggctgccaggtaccctgggcctggcgctgcagacctgagctggcttggacccatttgaggactgaactaggcaggcaatggctccagtgccctccctctgttccctggaccaccaccccacgtagctgctcacaccagcctccgggtgcctccctctgcttgtacagagcccatggtcgggacagtgccctggcctttgccggggaggaggatgctctgagattcagggtggggctggcaacccctgaagagaacacttcctgttggtctgtctcttcccaccttccatctgcacacacccccaaggtaagggtacagcccggctggcggcctccttgggaacgtgtaggccacggctctgccaccactaggtacctgctgagggcgctggctctgcagatcagaacaacggaggatagctttgtgcctggacccagagagtgtgggactccccgcttcatccccaccgtcccactccacagccttcccgaaacattccctggcaaacaaaggaacactaggagaaaaaatggaaaaacccttccagtaattaaaaaggaagaaaccacagaaagaaaactacagacctcaagattccactctgtgcccgcctctgccgggagggagggaggcacacaggtggagctgaccctcgtctttgtggcagcaaaaccaggatgcctggagctgtggcctgagggcctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacactaattgagcatgtgcgtggggtgggggtgtgtgtgcacatgtgagtgtgagtgtgtgtgggcgcttggtggggggttggggacagctggaaggtgccaggtgcacttggggttggggttggtgtgttgggtgttgaagtggaatcgtttcatcccagccatggaggccaccagcaggagtgttcatggggatgtgggcgaggtggggcactttgaaggaatggcggtctgctggtgccctcgaaggggcatccttcctggtcttcgctgacccagaggcgctgtgcctgcatatcatccaccaccaccctagcccagccttcccactgccccaggaaaagctcttctcctggccacctctgccccccagcacctcaaacttgcatggctgggctgtggcctctgcggccaggaagcctgacactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactcagctcctgctgctcttagggaaaggaggcctgggtcaagccagcatccccttggtaaagacccccgcaggccaccaggcattctggacacgcacacacacacacacacacacacacacacacaaaacttcacagcaggccagctgcagtgacttgtcatcaagagtcacctcagctgcgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgcggtgcggtcggtgcagcgtggccaatgcgcggcgcgcgcgggggacagagcaggaggcggtctgtcacctcggccactgctgacctgggctggcctcccccagccctcccgtggcggagccggcagcgatgctacaggcctaagttattgtttgcataaaaagaatcatgttccctgtgtacatttaagaaaaaaacaaaaaaacggaaatgtcagaattgtatggaaataaaacttgtttgaaaatttggaatagtgctgctgccagcttatttttctggtacttgtattttcacatgttaaatgatctttatatatgttgaattaacaaatattttgagtttctgagaaaaaacaaaacatattaatggtattgaaatgtgttagtagtctggctgtgtgcccaaaattctgtttcgcagcaaaagtgaagacctgtatgtaaagaaagtataacaattatttctttgtattttaggggctttaaccggaacatcgtctagctggtgttaggaatgtttgcttaatttccagacttttttttaaaaacacatcgtgggttttttgaggctccaacctgattagtgcatggtcagccctcaatgaaggctgaggcatctctgactgaggtgtttttgtttggttttgttttttaaaatcatgtatttgctacaaagtattgtacttgtctcaatgggaatggtgtaaaaaacaaaaggccttatgtgatctgtatcatagttaataaatgaatcttgtaaaaaaccaaaaaaaaaaaaaaaaaa

SEQ ID NO: 337 - DNA, 1217 bp, Homo sapiens
agggggcggggaggggcgcagggctgcgcgctcgccggcgctctctttcggtttggtcggcggctggaggagagtggacccccccactttaaggctctgtcctcggcgcgttcccgccgccccccggtcccgacgcggggctcggggatgcccgccagcatgttcagcatcgacaacatcctagccgcccggccgcgctgcaaggactcggtgttgccggtggcgcacagcgcggcggctcccgtcgtcttcccggccctgcacggggactcgctctacggcgccagcggcggcgcctcctcggactatggcgccttctacccgcgccccgtggcccccggcggcgcgggcctcccggccgcggtcagcggctcccgcctcggctacaacaactacttctacgggcagctgcacgtgcaggcggcgcccgtgggcccggcctgctgcggggccgtgccgccgctgggcgcccagcagtgctcctgcgtcccgacgcccccaggctacgagggccccggttcggtgctggtgtccccggtaccgcaccagatgctgccctacatgaacgtgggcacgctgtcgcgcaccgagctgcagcttctcaaccagctgcactgtcggcggaagcggcggcaccgcaccatcttcactgacgagcagctcgaagctctcgagaacctcttccaggagaccaagtacccggacgtgggcacgcgcgagcagctggcccggaaagtgcacctccgcgaggagaaagtggaggtctggtttaagaaccgccgcgccaaatggaggcggcagaagcggtcctcatcagaggagtcggagaacgcggagaagtggaacaagacgtcgtcgtcgaaggcgtcaccggagaagagggaagaggaaggtaaaagcgatttggactcggacagctgacggccgcgggacacttgcccgtattacttacctaactcgaaggacttgcacagacagacgatgctactttcttgcacacgcgctgccttgcgggagggggtcgagaaagaggaacgaggagctgtaaatagtgtacagagccgggagggtcggcgtctggggtcagggcgcgcacagcccagcagcccgaggccgcccgcgactagcccccaccgtagtatttatagttaaattaagggtgacagtacaataaagtgatggcgatgtaaaaaaaaaaaaaaaaaaaaaaaaaaaaa

SEQ ID NO: 338 - DNA, 618 bp, Homo sapiens
atggcggcagcggctgggggcgcggcgagccgccggggtgccgggcggccctgccccttctccatcgagcacatcctctccagcctgcccgagcggagcctcccggcccgggccgcctgcccaccgcagcccgccggtcgccagagccccgcgaagccagaggagcccggggcgcccgaggctgcgccctgcgcctgctgctgctgctgcggcccccgcgcggcgccctgcgggcccccagaggcggccgccgggctgggcgctcgtctggcgtggccgctgaggctgggaccggcggtgcccttgtctctgggtgcgccagccggaggttccggggcgctcccgggcgcggtcggcccgggttcgcagcggcgcacgaggcgccaccgcaccatcttcagcgaagagcagctgcaggcgctcgaggcgcttttcgtgcagaaccagtatcctgacgtgagtacgcgcgagcgcctggccggccgcatccgccttcgcgaggagcgcgtggaggtctggttcaagaaccgccgggccaaatggcgacaccagaagcgcgcgtcggcttccgcgaggctcctgcccggcgtcaagaagtccccgaaggggagctgctga

SEQ ID NO: 339 - DNA, 1720 bp, Homo sapiens
ggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaaggcttctttagacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactc

SEQ ID NO: 340 - DNA, 1212 bp, Homo sapiens
gaggagcctgagccgagcggtactccgcagcatcacgtgccagggtggggggctataaaatacccgagccggggcgccgggcgggggacgtgaggaccagccctctccggggacccctttgttcccagcccagacgccaacacctctgcgtccccaagggcttgactgcccgtgtctgcgcggctcccagggcagagcttagaacactagaggagaggggtcgccgcgaactgccggggcttccagccacccacccctctcgacatgtcgcgctccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagagccagttctcttcggctcctggggacgcgcagttttgcccgcgggtgaaccatgcgcatcatcaccaccacccgccgcagcaccaccatcaccatcatcagccccagcagcctggctcggccgcggcggcggcagcagcagcagcggcggcggcggccgcggcggccttggggcacccgcagcaccacgcacctgtctgcaccgccaccacctacaacgtggcggacccgcggagattccactgcctcaccatgggaggctctgacgccagccaggtacccaatggcaagaggatgaggacggcgttcactagcacgcaactcctggagctggagagagaattctcttccaacatgtacctgtctcgactccggaggattgaaatcgccacttacctgaacctgtcggagaagcaggtgaaaatctggtttcagaaccgccgagtgaagcacaagaaggaggggaagggcacgcagaggaacagtcacgcgggctgcaagtgcgtcgggagccaggtgcactacgcgcgctccgaggatgaggactccctgtcgccggcctcagccaacgatgacaaggagatttcccccttatgagggagggcctcctccctcacatcccccgctcct

SEQ ID NO: 341 - DNA, 1736 bp, Homo sapiens
cggcggcggcggcggcggtggtggctcgcgcagcttgttggctcgctatataaaggagagaagcgggcggaccggacggctggagctgcagccggtggcggcagcggcggcgcagggagcggtgaccggtggtggtttccctccttggcgcggggtggggagcgggcaacgccccccggacccctgaagggtcgtggctttttttttttttttaaggcgattctcgaggttttcagctgcgggaggagtgcccccctcctcctcctctctccgctctcccctactccttcaggattgattttgtttaaaattttttccccaatcttgcggtgatttgggtcaccctccgggtgttatagtttttttttttttggttttgtttttatcttgttttcttggggttgccccctcttgtttgtgttgtgtgtggaaatggcgaactcggcaaatacaaacaccgtgcctaaattatacagatctgtgattgaagatgtcattaatgatgtgagagacatctttctggatgatggagtggatgaacaagtactgatggaactaaaaactttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaagccacagcaccacaagttattgttccagattctaagttgatacagcatatgaatgcatcaaacatgagtgctgctgctacagctgctaccttagcactccctgcaggtgtgactcctgttcagcagatattaacaaattcaggccagcttcttcaggtggtcagagcagccaatggtgcccaatatatctttcagcctcagcagtcagtggttctacaacaacaggttataccacaaatgcagcctggtggagtacaagctcctgttatacagcaggtgctggctcctcttcctggagggatttcaccacagacaggtgtcatcatccagcctcagcaaatcttatttacaggaaataagactcaagttatacctacgacagtggcagcacctacaccagcccaagcacagataactgcaactggccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagagcccctcaatagtgaagatgatgtgagtgatgaggaaggacaggaactctttgacacagaaaatgttgttgtatgccaatatgataagatacacagaagtaaaaacaaatggaaatttcatctcaaggatggcattatgaatcttaatggaagagattatatattttccaaagccattggagatgcagaatggtgaagagttgctttttttcttttataaataaaagaaacttaaaaaaaatgtaaagcggacagtttgaaacttggggcatatgccaaccaaaacttcgtttctgcatgtcagaaaagtgcagtagaagcaaagctactggaacaaagatagaccttgacaacatagacactacttac

SEQ ID NO: 342 - DNA, 1582 bp, Homo sapiens
gagcacttccgggtcgtcagctcagttctgcggtttctgcggcggctggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttttttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcagttgtaactttacctgatgaaagcatcagcaggggcaaaaccaaactctggatggaattttttaagaaaatcccttgctttttaaaatacaaaaccaaagttaatcattggtataaaaaaacccaagtacaacttgattaggaaaagttagacaatcatagcaaaaacaaaaccaaaaaactttccttcttagaccaggtaacatgaggaagggggaaaaaaacccaaacaaaatagtccccccacatgacaggtgtcttcagcttgccatattgatccaaagttcatacattttatcatgtacaagatacattagacttacaataaagtctaattattagacttttatgtcagtggattgtgcttgcagaaatacagaagtaacatactgaccctaggtgaggagtttcttacatggttaactggattgacccaattggagtaaaagatttttgctgttacctcgatgctcctgcagttgttacctcagcatgccactgtagtccttgactctcacattaaaactaactttggctaggtactggtggctcacacctgtaagtaatcccagtactttaggaggctgagactggaggattacttgagtccaggagttggagaccagcctggccaatatagactgtccctacaaagaaaataaaattgtttcatcttccaa

SEQ ID NO: 343 - DNA, 1651 bp, Homo sapiens
acgactgcgtgggtgagtcgtctataaaaactcatctctgcgcgtctcttcgccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaattggacttggttcctgggaggagccccatctctgtggcagcggcagctatttacatggcctcacaggcatcagctgaaaagaggacccaaaaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactcaagtttttgttatatgttacatgtaacttatgatacataattacaaataatgcaaatcattgcagctaataaagctgatagactttatttccattacttatatatacatagttttttattttaataaatttatggaaagagcaaaagcttttgagaaccattgttaacatcaacatcatagtttccagtttgaaaggatgtgtatgtgagatttattatgtatattattaaacaagaagtgatgagcttgggccttgaaaggcaccagcttgagagacattaaaatgttctaagtaaaaaaa

SEQ ID NO: 344 - DNA, 3033 bp, Homo sapiens
gtcgcgcaaggggcgtggttcatttaagccggtagttgaagcgctgggggcagctgtagtgggagtgttccaggattcgccttgtatatttaaagttggagttcgttgctaaagatggcagacccagatgtcctcactgaagttccagcagcattgaagcggttagccaagtatgtgatccggggattttatggcattgagcatgccttggccttggacatcttgatcaggaactcctgtgtgaaagaggaggatatgctggagctgctcaagtttgatcggaagcaacttcgatcagttttgaataatttaaagggagacaagtttatcaaatgcagaatgagggtagagactgctgcagacgggaaaaccactcgccataactactacttcatcaattatcgtactcttgttaatgtggtaaaatataaactggaccacatgagaagaagaattgagaccgatgagagagattcgaccaaccgggcttccttcaaatgtcctgtctgtagtagtactttcacagacttagaagctaatcagctctttgatcctatgacaggaactttccgctgtactttttgccatacagaggtagaagaggatgaatcagcaatgcccaaaaaagatgcacgcacacttttggcaaggtttaatgaacaaattgagcccatttatgcattgcttcgggagacagaggatgtgaacttggcctatgaaatacttgagccagaacccacagaaatcccagccctgaaacagagcaaggaccatgcagcaactactgctggagctgctagcctagcaggtgggcaccaccgggaagcatgggccaccaaaggtccttcctatgaagacttatacactcagaatgttgtcattaacatggatgaccaagaagatcttcatcgagcctcactggaagggaaatctgccaaagagaggcctatttggttgagagaaagcactgtccaaggggcatatggttctgaagatatgaaagaagggggcatagatatggacgcatttcaggagcgtgaggaaggccatgctgggcctgatgacaacgaagaggtcatgcgagcactgctcattcacgagaaaaagacttcctctgccatggctggttcagtgggggcagctgctccagtgaccgctgccaatggcagtgactcagaaagcgagaccagtgagtcagatgatgattctccaccccgtccggcagctgtggctgtgcataaacgagaagaggatgaagaggaagatgacgagtttgaagaagtagcagatgaccccattgtcatggtggctggccgtccgttctcctacagtgaagtgagccaacggccagagctagtggcccagatgacaccagaagaaaaggaagcatatatagcaatgggacaacgcatgtttgaggacctctttgagtgagctttccctaattctttctcctttctctaatgctcagttcaaaaaggaatgtctcatctttgaagaaaagtatttaagtggctttctgcccctcttgatgtaagcaactgtccatccttgtgcaaagattgatggtagagagtttgacttttatgccagaaactttcccagcaaggtagggtgctgagaatcctacccttccttgctgtcactacagtattaatattttactgtattttcttttcttttttttttttttttggagatgaagtctcactcttgtaccccaggctggagtgcaatggcgtgatctcggctcactgcaacctctgcctcctgggttcaagcgattctcctgcctcagcctcccgagtagctgggattacaggtgcctgccaccatgcctggctaatttttgtatttttagtagaggcagggtttcaccatgttagccaggatgatctcgatctcctgacctcatgatccacccgcctcggcctcccaaagtgctgtattttcttatctgatttttttcttgccttattaagacataattttctcccttctgaaatgagtgagggaagttcataaggtaaatccttcccatccatctgtttactacaataggttacaataattcactgatcacatccattttatctgttctagccaggcattccaaacaatttcttatactgctgcccaccaaagcagcttgccaacagtcaaatcactgattgggggaaaaaatcctgaaattttgcttagaatttgagcatttcctcaaaattgagatggatcaatatgtaaggggaggtgggagcgtgtgtggaagggggagagatatacttgagtcttatgattaatgtctaaaccagaatttgtgtctttagaactgaccagactggtagattttattgtattgcttaatgtcttttggtttggatttaggatgatagaaaacagaagtataattggtaaacccttaggaagaaattagaaaaacatggacgtaagacaagaagtctctgtgaagggttgaagagtgacaagcattggtaacagtgccttagaactgtgtcagttagtctgatttggaaatcctttatgtaaagctgagactggtcctggttttgttccctttgggtacagacctcttgtcagtgctataaattgtttaatgaggccattccagcagaaatcaacagaataattgattactcttctctctctctgtcactctccctctttctaaacatcattgaaggctgtctctcttttaatttttgtcagacacagtattttagggtgcatccagtataccattgagcattgtaacctcaggaaacagtttattttgggttctgatatgtagcatggtattttccctaaggcagaactttaaaaataaagaactttcacacaagggtctgtaacaattgtatatcttacaatatttttccttgcattgtaatttttaagtatttatcattttatagtacacatgtaaagaatatatgagccttgtatggagtgatgtttcatttacctgggttgtgttaatgactgaatgttgacaataaatctgttttatactga

SEQ ID NO: 345 - DNA, 1560 bp, Homo sapiens
cccgatcgggaagtggcgggcggagtcccgggtccagtcgccgcctcagctaccgccgctgccgccgccgccgccgccaccgccagtggtgagaccccgacctggcgggtcagcgctgggcgtgcgtgcgggcaggcgggggcgctgacgagaagcaggaagagggtgcagtgccggcgtgggcggccggccgaggcggaggcgcaggaagggggcggcgagtcgtgcgaggctgcccttctcactcagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttttaagaaaaaaaaaaaaaaaaaaaaaaaaa

SEQ ID NO: 346 - DNA, 2551 bp, Homo sapiens
actgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagactctgtctcaataaataaaaaataataataaattg

SEQ ID NO: 347 - DNA, 1469 bp, Homo sapiens
gtgttcctcttttcctcggttcccagtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatggccgagcgcggggaactcgacttgaccggcgccaaacagaacacaggagtgtggctagtcaaggttcctaaatatttgtcacagcaatgggctaaagcctctggaagaggtgaagttgggaaactgcggattgccaagactcaaggaaggactgaggtgtcatttactttgaatgaggatcttgcaaatattcatgatattggtggaaaaccagcttcagtcagtgctcctagagaacatccatttgtcttgcaaagtgttggaggacagacattaacagtatttactgagagctcatcagataagctgtcattggaaggaatagtggtacaaagagctgaatgccgaccagctgccagtgaaaactacatgcgattaaaaagattgcaaatagaagagtcttccaaaccagtgaggctatcacaacagctggacaaagttgtaacaaccaattacaaacctgttgctaatcatcaatacaatatcgaatatgaaaggaaaaagaaagaagacggaaagcgagctcgagctgataaacaacatgttttagacatgctattttcagcctttgagaaacatcaatactataatcttaaggacttggtggacatcacaaagcaacctgtggtgtacctgaaggaaatcttaaaagaaattggtgttcagaatgtaaaagggatccacaaaaacacatgggagctgaagccagagtacagacactatcaaggagaagaaaagagtgactaagaagactcctagccagcatgctagtgaaacgactagcagcgatgctatgcaaaaggcgctgatactggaaggcttgaacaccgtatgttaataggggttaagtgacagtactttgatttctctcggtaaattttttaaacctgtaattcttgtaaagtttcttaactgtttttttgaggagaaagaacagatttatttatagacttaacttgtattaaaccagattattcacagtaggaataggggttggaggattaagagggtttttcttaaatattagcttttaatgtgtacaattaggaaatttttttaagtgaggactctctacccttgccgtatctaaggagctgaggtaatacagatccaaggagaattgtatagcaagaaaaaaacagtcaactacagaaactcttaaaaggaataaaaacccaaagttccttattttgaaattgtcaaagaacaaagcggtgtttttcttttaaacaggtgatcacgtttcgtgttcatactcaacgttaataaaaggagagagtttgtagtgaaaaaaaaaaaaaaaaaa

SEQ ID NO: 348 - DNA, 3308 bp, Homo sapiens
ctccttccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctgcaccttctagccaccatggcaacctcatctgaagaagttttgctgattgtaaagaaagtgcgtcaaaagaagcaggatggagctctgtacctcatggcagaaagaattgcttgggcacctgaaggcaaagatagatttacaatcagccatatgtatgcagatattaaatgccagaaaattagtccagaaggaaaagctaaaattcagcttcagctggtcctacatgcaggggacacaactaacttccatttttccaatgaaagcacagcagtgaaagagcgagatgcagtaaaagaccttcttcagcagctgctgcccaaattcaagaggaaagcaaataaagaactggaagagaagaacagaatgctgcaagaagatcctgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctgcttccaattctaaatccataaaagagaatagtaatgctgccatcatcaagagatttaaccatcacagtgccatggtcctggcagctggactcagaaaacaagaagcacaaaatgaacaaactagtgagcccagcaacatggatggaaattccggagatgcagactgctttcagccagcagtcaaaagggcgaaattacaagagtccattgaatatgaagacttggggaaaaataattctgtaaaaacgattgcactaaacctcaagaagtcagataggtattatcatggtccaactccaatccagtcactacagtatgcaacaagtcaggacattattaattcttttcaaagtattagacaagaaatggaagcttatacacccaagttaactcaggttctctcaagtagtgctgccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactcccagagctgatgctattgtacttgcacattggagactgaaaggaaagaagggactaaatgctggggaggtaaattaagacagaaccaaatgagctaagttgcaaatatatatatatacacacacacacatatatgtacatgtgtatgtacatatatattttaaaagactgtttactgcagttgctcaggaactgcttttgattcacattaagctgctttcagaaattaaaaaaacactttttaaagggtgcattgataaaatctgaggttttttggttgtcgtttttttctgtgtacatttttttcctaagtttatggcacagggtagaccttaagtattcctcctccatccttcattcttcaccctccattggatcctcaagttttaatgaattccaattataccttacatcagcaagttaaaaaaagtactttaaaataaagcaaagggagactgttgctcaaccatcaggaaacagttgtcagaagacatcattggttctgtgtttcctacggaaataagaaacgataaatattgcactgaatgtttgtggtttggagtccctgaataataaagagggaatatatttgcagaaagtcgcatagggttttttaatgcagaattttgtcagaagacaatggcgctgcatgtttttctttgagtgcaaatgtacattgctaagatttttttaagatggcatgtgctttgaaaagaagatattgcatttttaagagtttaaaaatcttatgagtgagaaatattaaaaaaatcttattttcacctctttagaagaaataaaagatgtttctcctatctccttttctctagtatttgactgttactgtccttggcgaatcgataatcattgcatagtgactgaaaagcctaagtgcaaaaaaaaaaaaaaaagatgttcttgtttctgaacttcgtgccatattttgttcctgatgggatcaacttaatgtttaagactttagatgtcttgtattaaaaattacacaaaaaaagtaaaactttttatacttacccttttaactct

SEQ ID NO: 349 - DNA, 3078 bp, Homo sapiens
aggaggctgagtcctggccgcgggccggggccggggcgccgctggcaggagcgcttggggatcctccaaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcgtggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaaaaaaaaaaaa

SEQ ID NO: 350 - DNA, 3551 bp, Homo sapiens
gaaagaaagagaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatgtgggaaaacgcaagatagaccaggagggccgtgtgtttcaagaaaagtgggagagagcgtatttcttcgtggaagtacagaatattccaacatgtctcatatgcaaacaaagcatgtctgtgtccaaagaatataacctaagacgccactatcaaaccaatcacagcaagcattatgaccagtatatggaaagaatgcgtgacgagaagcttcacgagctgaaaaaagggctcaggaagtatctcttaggcttgtcagacaccgagtgtcccgagcaaaaacaagtgtttgcacacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatcttttcgcgtgttgagaagagcctgaaaaagttctgtatcgactggtcgaaattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagtgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggcttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtgatggagagaaaactcctggcagggccctatggtgggaaaggctggagtcttctagtcccaagggattgggagatgacaaaatgaatttttttttcttttttgagatggagtcttgctctgtcgcccaggttggagtgcagtggcgtgatctcggcttactgcaacttccagctcctgggttcgaacgattctcctgcctcagcctcccgagcagctgggactacaggcgtgcgccaccatgcctggctaatttttgtattagtagagatgaggtttcaccatgttggccaggctggtctccaactcctgacctcaggtgatccacctgcctcgacctcacaaagtgctgggattacaggcatgaaccactgtgcccagctgacaaaatgagttcttaaacttttttttttttcagttttttttccactttgaatcagaaatataatctgcagtatcatacttgtttatattacattgtgtgcctcactattcattaaaaatcaagaaagttttattgt

SEQ ID NO: 351 - DNA, 1404 bp, Homo sapiens
atgcgcgatctcccggagcatgcgcagcagcggcgccgacgcggggcggtgcctggtgaccgcgcgcgctcccggaagtgtgccggcgtcgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacatttgattccttatcatttc

SEQ ID NO: 352 - DNA, 7124 bp, Homo sapiens
cgttgcgcatgcgccccgggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatcgttgcctcccaggccatgcggtacagggccttgataggccaggagggggatcccgacctgaagctgcccgacttctcctactgcatcctggaacggctaggccggtccaggtggcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatggggctgctacagtttggtcccacggaaaagtttcaggataaagatcaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggcgtggtgcgctgcccgcgcgtcaggaagaacagcagcacagaccagggcagcgacgaggagggcagcctgcagaaggagcaggagagcgccatggacaagcacaacctggagcgcaagtgcgccatgctggagtacaccactggaagccgtgaggtggtggatgaaggcttgatccctggagatgggctgggtgccgcagggctcgattccagcttctacggacacctcaagcgcaactggatctggaccagctacatcatcaaccaggccaaaaaggagaacactgccgcagagaatggactcacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataaagtgtgcctggccgaggtgtaccaggataaagcacttgttggagatttcatgaatcgaagaggtgactatgatgacccaaaggtttgtgccaacgagtttaaagaatttgtggagaagcttaaagaaaagttcagttcagccctaaggaattctaaccttgaaatcccagacacactccaggagctgttcgccaggtaccgagttttggcaattggggatgaaaaagatcaaaccaggaaagaggatgaacttaacagcgtggatgacatccactttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctgccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgtcggtgagttcagttccccaggccaagagcagctgagcggccaggcgcagcctccagagggctctgaagaccccagagggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgcaaaaaaaaaaaaaaaaaa

SEQ ID NO: 353 - DNA, 3935 bp, Homo sapiens
gcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgaggcttgagtgtgcgtcagaatcccctgaagagcttgttaaaacacaaggtgctggccccatccagaattgctgattcggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcctaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaaaaaaaaaaaaaaaa

SEQ ID NO: 354 - DNA, 2958 bp, Homo sapiens
tgctggccccggcgaggtagcttctggaaggcgctgctcttccggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagagttactatgaagccaatgatgttacttctgctattaacataattgatgaagctttctcaaagcaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatcctctcttgacaacactagtagaacagaatcctgaagatatgggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcaggaactgaagttattgcttcatcgttctactctgttgttttcacaaggcaaaatgtatggttatgtggataccttacttactatgttagccatgcttttaaaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaagcaatatttgctgtgctcacaagcgtcttgacaaaggatgactggtggaatcttctgttgaaggccatatactccttatgtgacctatcccgatttcaagaggctgagttgcttgtagattcctcattggaatattactcattttatgatgacaggcaaaaacgcaaagaactagaatactttggtctgtctgctgcaattctggacaaaaatttcagaaaggcatacaactatatcaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggacagtatgtgcaagcctttcgcactcaccctgacgaacctctctatagcttctgtataggcctaacctttattcatatggcatctcagaagtatgtgttacggagacatgctcttattgtacagggcttttcctttcttaatcgatacctcagtttacgtgggccctgccaggaatcattctacaatttgggccgtggccttcatcagttggggctgattcatcttgcaatccactattatcagaaggccctggagctccctccacttgtggtagagggtatagaacttgaccagttagacttacgaagagatattgcctacaacttgtctctcatctatcagagcagtgggaataccggaatggctcaaacgcttttgtatacctattgttctatataaagcaccgcaactgagaacagagcaatggcagctgctgtgtgaggaccagtgtcttctgtctcagggcttattatttgtaactccaaaatagaaatgaccatttcagaattacctaacaaacagtgtatttatttttaatatgtgatcatgatcttgtggtatatatgcaaaattattcctacaaaaaaaaaaaaaaaaaaaaaaaaa

SEQ ID NO: 355 - DNA, 3866 bp, Homo sapiens
gagctcaatccctgggcagggaaaagggggtcctcggggctccccgctcgctgtcctttttctggacaggcagttccttggccacctggtagggccgcgttgcctggcaacggcggggtccttcttggctcggcggcgctcggggcctgaggggagaaaaccgccgcggagggcgctgggggtggcggcggcggtccgggaggtggtcgcgcgactgcgtggagcgccagggcgtccgacctctgcacctgagagaagatgaacacggccgaccaggcccgggtggggcccgcggacgacgggcctgcgccgtctggggaggaggagggagaggggggcggcgaggcgggcgggaaggagccagcagcggacgcggccccggggcccagcgctgcattccgcctcatggtgactcggcgggagccggccgtgaagctgcagtatgcggtgagcggcctggaaccgctggcttggtccgaggaccaccgcgtgtctgtgtccacggcccgcagcatcgctgtgctggagctcatctgcgacgtgcacaacccgggccaggacctggttatccaccgcacctcggtgcccgcaccgctcaacagctgtctcctcaaagttggctcaaaaacagaagttgctgagtgcaaggagaaattcgccgcctccaaggaccccacggtcagtcagactttcatgttggatagggtgttcaaccctgaggggaaggctttaccaccaatgagaggattcaagtacaccagctggtctcccatgggttgcgatgctaatggcaggtgcctcttggcagcactgaccatggacaatcgcctgaccatccaggcaaatctcaacagactgcagtgggtccagctggttgacctgactgagatctatggagaacgtctttatgagaccagttacaggctctctaaaaatgaggccccggaaggaaatctcggggattttgctgagtttcagaggagacacagcatgcagaccccagtcagaatggagtggtcgggcatctgtaccacccagcaggtcaagcataacaacgaatgccgggacgttggcagtgtgctcctggctgtcctctttgaaaacggtaatatcgccgtgtggcagtttcagctgccgtttgtaggaaaagaatccatctcttcatgcaacacaattgagtcaggaatcacctctcccagtgtattgttttggtgggaatatgagcacaataatcgaaaaatgagtggccttattgtggggagtgcttttggacccataaaaattcttcctgtcaatctcaaagcagtcaaaggctatttcactttaaggcagcctgttatcttgtggaaagaaatggaccagttacctgtgcacagtatcaaatgtgtgccactttatcatccttaccagaagtgtagttgcagcttagtagtggctgcaagaggctcttatgtattttggtgtcttcttctgatctccaaagcagggctgaatgttcacaattcccatgtcacaggccttcactcactgccaattgtctccatgactgcagacaaacagaatggaacagtctatacttgctccagtgacggaaaggtgaggcagctgattcccattttcacagatgttgcattgaagtttgaacaccagttgattaaactctcagatgtgtttggctcagtgaggactcacgggatagcagtgagcccctgcggtgcatacctggccatcatcaccactgagggcatgatcaacggcctccaccctgttaacaaaaactaccaggtccaatttgttactctcaaaacctttgaagaggcagctgctcagctcctggaatcttcagttcaaaacctttttaagcaggtagatttaatagacctagtacgctggaagattttaaaagataaacatatccctcaatttttacaagaagctttggaaaaaaagattgaaagcagtggagtcacctatttttggcgttttaagcttttcctcctgaggattttatatcagtcaatgcagaaaaccccttcagaagccttgtggaaacccacccatgaggactcaaaaatcttactagtggattcgcctgggatgggcaatgctgacgatgaacagcaggaagaaggcacttcttccaaacaggtggtgaagcaaggcctgcaggagaggagcaaggaaggagatgtagaggagcccactgatgactcgctccccacgactggagatgctggaggccgtgagccaatggaagagaaactcctggaaatccaagggaaaatcgaagctgtggagatgcacttgaccagggaacacatgaagcgagtcttaggagaagtgtatctgcacacctggatcacagaaaacactagcatccccacccgcggactctgtaactttttaatgtctgatgaagagtatgatgacagaactgcacgggtgctgattggacatatctcaaagaagatgaacaaacagactttccctgagcactgtagtttgtgtaaagagatcttgccattcacagatcgcaaacaggcagtctgttccaatggccacatttggctccggtgcttcttaacctaccagtcctgccagagtttgatatatagaaggtgtttgctccatgacagcattgcccggcatccagctccagaagatcccgactggattaagaggttactgcaaagcccctgccctttctgtgattctcctgtcttctaaataatcagtgacgggaagatggaagggcatgatgaactctgccatagaaaacttcctccagcctgaagagaaggatgcactggaggaagccggaccctcacgagtggagagaagtccttggtgattgtaaagagggcccctggagctcatttctgaatcgcactctccatttccagagactaaaggatgtcctttgaaatggctggactcagagagttggagtcgttttgagatgagcattagccccagctttgtaaccaatgaggaacacttacttatttttaagtatcttgacagaagcaatttgaacacagtgtcccgtcatttctagaaacagaatggtctcttctagagagcttggataaggaccttgctgggttgagttaggttttaatccttgctttggtttggaactgccttcgggctccagaacttaaattgcttggtccgtggcatctgatgtaccaacagagattaaaagtgtaaagcaacacatgggctgatgttttgttctcagaaaatagctgctggtctgcatccctccattcttgttttttatgcatatggaaaacattttcctaaaactctatattcttaagttgaagccaagactaaaatttaatgtgtcaaatgatctggtgactattataatgaataattgtgacttatttttcattctctcctgggtcatcaggtttcctgacccaactccttaatccgtataaagatgtcaaatactgtagttcacccacgccacagccctgcttcagacttaactgtggtagcctagatgagctatttgtacacagaggaaaaaaagatattttcctcttttagtaataagactttcagtatttttaatgttgacatttccagatgtttcatttagtatccaggggtctgtctggagacttctagagagggacagctcagaagtgagacccttgagctctggtgctgtaagcttgtgcaattaagttgaacagagcctgggaatttctttcctctgcacagtcccttgatatttggaatccaggttctgcccccaacccctacccacccagtggtctgttaagatgtctcagatggggctgggcttggtggctcatgcctgtactctcaacactttgggaagcaaa

SEQ ID NO: 356 - DNA, 2436 bp, Homo sapiens
gattctcattggctgaagtcgagggaggtttgtgtcttattatcctccgggtccctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggagcccggaacgattccttcgcggaacaattgaggcgaggcctttgggagtactttgtgggacggaccctggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgagaaaaaaaaaaaaaaaaaa

SEQ ID NO: 357 - DNA, 1749 bp, Homo sapiens
gcggtcttatataagccagatccgcaggggagtccgcagaagggttaaacaggtctttgggcttcggcgacctcgcccgcggcagaaaccggtaagaagacagtgggctgcgcgtctcattttcagccttgcccggactctcccaaagccggcgcccagtagtggctccagagcccacaggtggcccccggcagtctctggggcgcatggagcggcgttaatagggctggcggcgcaggccagtagccgctccaacatgaacctcgtgggcagctacgcacaccatcaccaccatcaccacccgcaccctgcgcaccccatgctccacgaacccttcctcttcggtccggcctcgcgctgtcatcaggaaaggccctacttccagagctggctgctgagcccggctgacgctgccccggacttccctgcgggcgggccgccgcccgcggccgctgcagccgccaccgcctatggtcctgacgccaggcctgggcagagccccgggcggctggaggcgcttggcggccgtcttggccggcggaaaggctcaggacccaagaaggagcggagacgcactgagagcattaacagcgcattcgcggagttgcgcgagtgcatccccaacgtgccggccgacaccaagctctccaagatcaagactctgcgcctagccaccagctacatcgcctacctgatggacgtgctggccaaggatgcacagtctggcgatcccgaggccttcaaggctgaactcaagaaggcggatggcggccgtgagagcaagcggaaaagggagctgcagcagcacgaaggttttcctcctgccctgggcccagtcgagaagaggattaaaggacgcaccggctggccgcagcaagtctgggcgctggagttaaaccagtgagccgaggcccgcgccgaggacctggccaggccagccactcctgaagccccgggaggagaggaaggcagcggcgaacgccaggctctgggctccggcgactggtgctacgcatcccgcggagcttctgctgagcgccggcaggtcgtcggctgcaaccacacacttggatcgcacgtgcaatgtcctttgattttttttaatacattaagagaaagagaaatatatatatatccacccccagcccaaccgagggcggcccttggcggcaacatgcaagaaggagggactgtcgaacccaagggctcaaagacgcactcttccacccttttggagcgaatttagaacctcagccctatctccatttccctatctggctctttctctcttgtccctccatatgatccgccccgacgccgtcttctctaattaaaatgcaataaggaatcaattcttttctgcctgagaaagagaaccagacgcaggaagatgaaaggctgccctttgttcttcgaatcgtggtggttttattttatttttctttttgtcgctgcacttcctgtttagttccaagggaaacactttctctctttctctgtctctctcttttcttccttcttttccttcctttttgtttctatctaaataaaagctttccctgtgttggaaagtttttatgtatttaaactacctaccatgcctgttgtgctcaggtgtttgttcatcctgccatccccaacccttttctacctcaagtctgtgtgaccactcacagcccccctcccttcgccaaagcagtgtctatgctcttgattaataaaacattttctgaaatcaaaaaaaaaaaa

SEQ ID NO: 358 - DNA, 2368 bp, Homo sapiens
ctgtacatggagatcttgctgggaaaatccgcttgctcccctcacgtcgtccagcccaggagaaccaccgccgtcaccccggagcttcctcggccaccgcgcagagccctccgagagcccgagccgcggtcttcgagctccaaggctcattcagggccccagatccttgccccgaaaggagaggatctgagaaaatggatgcactgagacctctctgaaaaccctccgagagagcgcgagaggagcgaggacacgttactcgcagctaaaatcacatttaaggaccaaaacaacaacaaccaaaaatttcattaaaacaataagcgcccaagaacccagatcgggctggtggggggaggggaagaggcgggaaggggagggtcgcacggaggtagctttgcagtgagcagtcgaccccgccgccccccggcacagctggaccggctcctccagccgcggctcagactcgcccctggattccgggttagcttcggtgccaggaccgcggcccgggcttggattcccgagactccgcgtaccagcctcgcgggagccccggcacctttgtatgagcacgagaggattctgcctccgcgcagcagcccgggaagcaggagccgaagcgcgggccgtggagcaaggcgggaaccggaggcggcggcggcggcggccaggggcgcacggtgccaggaccagctcgccgcgccccatggggagccggcggccgcagcgctgctgaggcgggcccggctggccaggcggggggacggggcccgggctgcagcagccccctctgcggctgccgggcgggcccgggcgcccgggggctggggggtggggggtgggggaggacgccgagcgctgaggcaggggcccgggccgagggcgcggcggggctgcgcgcacgctggggcgcgtggaggggcgcggagggcgaaatgagtctggtaggtggttttccccaccacccggtggtgcaccacgagggctacccgtttgccgccgccgccgccgcagctgccgccgccgccgccagccgctgcagccatgaggagaacccctacttccatggctggctcatcggccaccccgagatgtcgccccccgactacagcatggccctgtcctacagccccgagtatgccagcggcgccgccggcctggaccactcccattacgggggggtgccgccgggcgccgggcccccgggcctgggggggccgcgcccggtgaagcgccgaggcaccgccaaccgcaaggagcggcgcaggactcagagcatcaacagcgccttcgccgaactgcgcgagtgcatccccaacgtacccgccgacaccaaactctccaaaatcaagaccctgcgcctggccaccagctacatcgcctacctcatggacctgctggccaaggacgaccagaatggcgaggcggaggccttcaaggcagagatcaagaagaccgacgtgaaagaggagaagaggaagaaggagctgaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtggtaagggatcccgtcgtctcatagattctgtgtgcgtgaatgttccctcttggctgtgtagacaccagcgttgccccccgccaacctactcaaccccttccagataaagacagtgggcactagtgcgtttgtgaagtgtatctttaatacttggcctttggatataaatattcctgggtattataaagttttatttcaaagcagaaaacagggccgctaacatttccgttggggtcggtatctagtgctatccattcatctgtggtcgttccctctttgaagatgtttccaacagccacttgttttgtgcacttccgtcctctaaaactaaatggaatttaattaatattgaaggtgtaaacgttgtaagtattcaataaaccactgtgttttttttttacaaaaaccttaatcttttaatggctgatacctcaaaagagttttgaaaacaaagctgttatacttgttttcgtaatatttaaaatattcagaagtaaactaaattatcatga

SEQ ID NO: 359 - DNA, 5873 bp, Homo sapiens
gaaaaatgcttcctgtttctttaaaggcgctcgcggctcgggcggcccgggctggggaggcggtggcggcgggagctgcctcctctccgggcggcggcgctgactgatctcgcgaactgggcttctgtgtaaactgaggctaaacaaacacagatggagcgcagcgggcgttctccagaaatgctggcaaggaggcagcgacttcagatgacactctgagcgctccgggaacggacagcccggcggcttcccgaagccggcggcgcagctgcccggggcgagggggagaaagggagagagggagggggagggcgggcgaagcgggagagccagagactcctcggcgctgagcgcggcggcggcccgggcagccccacgcccctgcctcgcgcgccgcccgcgccatgaagcacatcccggtcctcgaggacgggccgtggaagaccgtgtgcgtgaaggagctgaacggccttaagaagctcaagcggaaaggcaaggagccggcgcggcgcgcgaacggctataaaactttccgactggacttggaagcgcccgagccccgcgccgtagccaccaacgggctgcgggacaggacccatcggctgcagccggtcccggtaccggtgccggtgccagtcccagtggcgccggccgttcccccaagagggggcacggacacagccggggagcgcgggggctctcgggcgcccgaggtctccgacgcgcggaaacgctgcttcgccctaggcgcagtggggccaggactccccacgccgccgccgccgccgcctcctgcgccccagagccaggcacctgggggcccagaggcacagcctttccgggagccgggtctgcgtcctcgcatcttgctgtgcgcaccgcccgcgcgccccgcgccgtcagcacccccagcaccgccagcgcccccggagtccactgtgcgccctgcgcccccgacgcgccccggggaaagttcctactcgtcaatttcacacgtaatttacaataaccaccaggattcctccgcgtcgcctaggaaacgaccgggcgaagcgactgccgcctcctccgagatcaaagccctgcagcagacccggaggctcctggcgaacgccagggagcggacgcgggtgcacaccatcagcgcagccttcgaggcgctcaggaagcaggtgccgtgctactcatatgggcagaagctgtccaaactggccatcctgaggatcgcctgtaactacatcctgtccctggcgcggctggctgaccttgactacagtgccgaccacagcaacctcagcttctccgagtgtgtgcagcgctgcacccgcaccctgcaggccgagggacgtgccaagaagcgcaaggagtgactggctgcaggcaagaccaaggccaccactgtgggccctccttccagtcaggcctgaggacaaggtgagctcgctgagtccagcctcgtggtcttctccaagatgccgccagatgcccagcctacagcctctcagggtcggatcggagcacgcctgcctccctctcccctccgccctcacccagccaatccgaggctgcttcgcactttgccctctgcctggtggggaggggagagctcagcccccgactcactcagaccccaaggcccactgtccagctgcagaaattcgttgccaaagattggacagagacaccgaaggaaatggggtggtgaaaccccacagcgaaaagccacaccgttgctctgtgacttttgctcctcctgttgcctgagccccatctcaagccaaagatgagtcagtggttctgctaggaactcatggaatggatgggcatttgatgacccctgggggtcatcttggccctctgacctggtgctctctctccactgggccttgtgctggctgagtgcaagacaagccttaggggctgtgagagggaggctggggtgcctgggcggggctgggagtgggacctgagatccctgcccactctctccccttcattggctgcccaggccactggccccagttctcagtgtcccttgggtccaggctccttgggccctaagcatcaccagaagggagtaagcagggagagaagcaatattactccctcccctacaccagggacttgccccagggcagctacctatgggtctttgcttccccagccagcctctcctcactgtgacccacccccatgggcccccgtcccaggcagccagcaccatgggcaggccctgccatggacagaaaaagagtttttctcttgttcagcctgcacgtggcctgaggaaggagtagaggctgggttggctggagccgtcctactgggcaagatggcgccccacttggagggcggtggtctgttacagggtgtgcaggggcagagaaggaagggaccaggggactgggccagtatgtggaggatggggcctgcgtgttcaaagccaaggcccgccccttccttgtgctcaaatggccaaagctgttcacgtctgtgctcaaccatctgcttcaaattgaagtaaaagccccaaaatgtcaagaaaatacttgtgttgagtggactctgtgggtgaccaggactttggccggtcatcagctggggagtgtgagggagggggttggtttctacctacaggttgagagcccttcaggatcaggcgctgtccgagtgagagtgtgtgtgtctgtgtgtggaagggggtggagggcggttcccacagtagtctcagcctggactagtgaccaggaggcctggtcaggaacacatgaggagccctctctgtccgcactgcactcaatctgtaccatggatttatgagataggggcccctattattaaccccgtttcacagatggggtaactgaggcctcaagtagacagggtcagtcggtgacagagccagtcatcgaatcaggatgggctcacttcaaatcctgtgctctcaaaccttttccagccccatcaccagtcccagcccaaagtctcttgtgtggccttgtcacattgcttcacctcagcgggcctaaggtagggacaataaaggcccattgggactgggggaaggggtgataagataaaaaataggagagcactgtcaaggcagaagggacagggctggccaaggaaagggggataggaggggaccggaggctgcagccatacaggacacagtttgtcccttggtttcaccagtgtcactttctcgtctctgctgctcagactcctgggctgggctggggctggctgcagggagccccccttgcagtagcgtttctcaggctggccctttaccaaggaccacagtgtccatgctgtcttggatccctaggctggcacagaaacaggggacccaggtggccctgagcactcctcagagcaaaggtgctctggaagcagactggacagagtgggcatggaatggggccaggagggtctgttaggaaggttcagccaccctgtgaagctggcacagataacagcactgctctgttgtccctcggagcctctgagtaaccctgatggcacttcctaaggcagcaggacatgtggactgaccagcatcaaactgttgacatagaagaccatttctattaccaaagggagtgtaccccattctgctgccaagggagcaaacccatggccttaccacccagaaagagcccatcctccacctcccatccccctcctgcatacatacttcattacatgtttccctttcattctgaagcatcattgatgaccagctgcctgtcagacactaagataggcagtgggaatgaagagatggatcttgtgtcatgcatggcatcacggagctctgggttctgtacggagggtgggacagacaggtagacaagcaaataattatgattatagcagatgactaaggtgttgtcgggagcttcaggaaaggaagaactaactcttggggaggttctcaggaaggatttccctggaaagtagccatgggacttgcgtcttaaatggtgagtaaaagctttctgagcaggggagtaggaaaagggctttctatgcagaggagcactcagcgctggcaggaaattggaatcacccaaggagattattaaatattaaatattgatatgaagtattgatgcccaatttcatctccagaaattctgatgtattggtctagggtgttgcctggtcattgggatttttacaagctcctcaagtgatcttaatgtgcaggcaaggttgaagccgctggtctaagtggggtctggtctacgataagaaagtgactttgagccatcgatttgggagacaggctctgggtggatgtgtgtgtgtgcacacatatgtatgtatgtggatgactaaaagtgcatgctctcctctcctttcccagcttcctctccagcacagcaacttgtgttcgtatgcacacacatgcatactctctctcatgggcacatgcatacccacacacacactcgtgtacatttccagaaaatggaattacatttcagatagattcagattccaacggcagtcttctaaacacttttatgcaagcagccattcaaggagaccctcagcaaaatataaatgacgaggagctgccctcatggggccctgtgaaagcactttgcagtccagccttgggtttgtggtcacagagtcacctgtggatgtttgtagcacactctccttgtcttgtctgctctgggtcaccaggcacaggccataaagggatgagggggccctctccagggacccgcaagatcttcctgggtatgtctgcatgaagccccacgtgtgcacacccatcttcatgtgtgtgtgtgccagcctcctgctctctgcagaacaaaaccagaaggaatggctctgggagttggagatctcagctcacaggccaagctttgcaagactctccaaagactgcccacagactgtgctgcttcctgggtctggcctgagactatcccagaagagagggttaaattctggaggtgaggttttgagcaagtgttcatccccccacactatgctccttcctgtctccatggccacatccttcaaggctctgtgctgttctctttttttctggatttctccacctccaccaagttcccctttctcacagctagtggaggcatgagtaggcaggtcccaggggctgggaactgggtagcattgccatgtgcagggactgtgttgggagctgcaggtacagagctcctctgtgctcaagagcttgccggtgagcctggacggaggcataggtgcagctaattaggataagacaggggccgcgctgtggtcagccgtgggaagccggcgaggggactggagttggggctacacttgcctccctcctatgctgcttcctgagccacgaagtggtcattgccagcatcccaggcaacaaacagcaagactcagacatctccaaggaaaccctttgagtggatctgtaccgttgttctcgtcttgctctcttgctgccctgccaccttcacagctgctttctgtttcctggttccaggaagacagcggggcacagggtccctgctttgtgaggagcagctggcttctccctttgcccccaggttttgccctcccacatgtctcccttctggtgacccggaccccagacaaactatgcctgcctccctgaagccaggcatcctgaggaacttgatagacaaacaatgacagtgttttccagaactgtgggtacgtgtctaatctcagatggtactatgaattcctggagatcaaagtttggatctaattcaacccctgatcctcgaaacggctttcttgcaaagtgtatatattggtttctttgctgaatgaatgaataaaacatggaaaatgtggtaattcaaaaaaaaaaa

SEQ ID NO: 360 - DNA, 3600 bp, Homo sapiens
gaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggtgagagcacagagccgggataagcagatagaagaaaggatgctgtctcacaggcaagatgacaacaacaggcatgcaaccaggcaccaggcaccaacggagaggcagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtaccattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcccttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaaaaaaaaaaaaaaaaaaaaaaaaaaaaaaaaaaaaaaaaaaaaaa

SEQ ID NO: 361 - DNA, 5743 bp, Homo sapiens
acgtgaccccagcacagctggaggcgggtccccgccctccccagggagcagccggttgaggcgggagcggtgcattgtgggcagaggggcgggggttgggaagatggcggctcccagcctcctcaactggaggcgagtttcttccttcacggggccggtcccccgcgcccggcacggacaccgagcggtggccatccgggagctgatgatcatctttggagggggaaatgagggcatcgcggatgagctgcacgtctacaacacggctacgaatcagtggtttctgccagctgttagaggagatatccctccaggctgtgctgcccatggatttgtctgtgatggtaccagaatattagtatttgggggaatggttgaatatggaagatacagcaatgagttatatgagttacaagcaagtcgttggttatggaaaaaagtgaaaccccatccccctccttctggtttacctccttgtcctcggcttggacatagcttctctttatatggtaacaaatgctatttgtttggtggcctggcaaacgaaagcgaagattcaaacaataatgttcccagatatttaaatgatttttatgagttggagctacagcatggctctggtgttgtgggttggagcattccagtgactaaaggggttgtgccttctccaagagaatcccacacagctgttatatattgcaaaaaagattctggaagtcctaaaatgtatgtttttggtggaatgtgtggtgctcgcctggatgacctatggcagcttgacttagaaactatgtcatggtcaaaaccagaaactaaagggacagtgccacttccacgaagccttcatacagccagtgttataggaaacaagatgtacatttttggtggatgggtcccacataagggggaaaatactgagacttcacctcatgattgtgaatggagatgtaccagttcattttcttacctaaatctggatacaacagagtggaccaccctagtatcagattctcaggaagataaaaaaaattcaagaccaagaccaagagctggccactgtgctgttgcaatcggcactcgattgtatttttggagtggaagagatggctacaaaaaagcactgaatagtcaagtttgctgcaaggatctttggtatcttgatactgagaaaccaccggcaccatctcaagtacagctgatcaaagccactaccaactcctttcatgtcaagtgggatgaagtgtctacagttgagggctatcttttgcagttgagtacagacttgccataccaagctgcatcatcagattcttcagcagcaccaaatatgcaaggagtcaggatggaccctcacagacaaggcagtaataacatcgttcctaacagtatcaatgatacaataaacagcacaaaaactgaacagccagccacaaaagaaacttcaatgaaaaacaaaccagactttaaagcactgacggattctaatgccattttatatccatctttggcatcaaatgcttctaatcataatagtcatgtggtggatatgctaaggaaaaatgaaggtcctcacacttcagcaaatgtaggtgttctaagtagttgcctggatgtaagaacagtaattcctgaaacatctgtatccagtactgtttccagcacacaaactatggtaacccagcagaccattaaaactgaatcatccagtacaaatggggcagttgttaaagatgaaacttcactaacaacattcagtaccaaatctgaagttgatgaaacatatgcactgcctgcaacgaagatcagccgtgtagagacacatgctacagcaacgccgttttctaaagagactccttcaaatccagtggccacagtgaaagcgggagaacgacaatggtgtgatgtgggaatttttaaaaataatacagctttggtgagccagttttatttgctgccaaaagggaagcaaagcatctcaaaggtaggaaatgcagatgtacctgactacagcttgcttaagaaacaagatcttgttccaggcacaggatacagattcagggttgctgcaatcaatggttgtgggataggtcctttcagcaaaatcagtgaatttaaaacttgtattcctggttttcctggagctccttctgcagtcagaatttcaaagaatgttgaaggtatccacctttcctgggaacctccaacctcaccttctggaaatattttggaatattcagcctacttggctatccgcacagcacagatacaagataatccaagtcaacttgtgttcatgaggatttattgtggtcttaagacatcatgtatagtaactgctgggcaacttgcaaatgcacatattgattatacatccaggcctgccattgtgttcaggatatcagcaaagaatgaaaagggatatggaccagctacacaagttcggtggcttcaaggtaacaataagaaagcacctttaaattgaattggtttttttactgaagctattgtgatgatgattatttattagtaactggttatgaagatttgtcatttaaaagagtattctctggctgtatttccagcagttatgaacttgagtttgtaaattgttcttaaaatgtatttgctgaattatagatccaaataaaagaaaagaagcaaagactctctgaaaattagtatatgagttcttccttacagatatagctcttttataaagaaaaacagtgaaattaagataaaagctagaaagctttattaccccaatatcttttataagggctgtgtaacccagtcatcctagagttattgagatgattctggtaactggctgttgtatactatgctgtcttatatagtaaatgttctctacattgtaaatgtcctacctttgagtactccttctatctttattctatatgagcagtgttcctctaacaactgtcttctattggataatatgtgtgatactataataattctaatagttatttgattcctttctttgtttacagttagcacagagcttaagaaattaaaaaagaggcaagtttagaaactgcttttgaacttttattattttccaagaatcatggtaaaatacaacaagaacaatgagttttcttgattcttaccaggccaatatatttgaatatatttttggccaaagcacttaacttatctggccctcattttcctcataacagatgagggagttaaagcagtttatcttttaggtccctttcagcactaaggttttgtgtttttagtagaagtgaagtatgtccctgaacattttcatctgtcttaatggctctaattttgcttttgctaaaattaaaatcttcataattgaattcaaaattaaagtatatgtcctcctattggagaaaaaaacaagcaccttaacaggacacaagttttaaaatagtgttttaaacatttgtaagatttttgtaaatgctctaaatgttttatttttgcattgtttttaccttgaaattgtataaacttttttactatgaaaatataagcattagacagctaactcaggttccattacaaccttaaagatacagataggcattataaacactctgctacaggtaacttgttttaaaccttttaggaatttcatggttccactgcctatttaaatctggaattaatatacagagcaataattgcagaaaagatatttcaaactaagagcttcaataactgcaggggcacaggtctatctttttttataccacataaccttatgccagtttaggttgactgagtagctatgtcctcaaatttcatgtatgataccccccagcaaagatggatttaattgtgcagaattgatatatatgtgtgttccagttactaatttaaagtgtatagaatattttaatatataatttttgtaaagaactgggatttttatactacagtatttgtaattaatgtgtctcactaattaagtttctcttgaagaaaatatgcaaattgttagacacataatgagtggtttccaaactctaaagataaaataaatgcactactatggtgttgttagaataccttttttgtggctgtatgaatctttactctttaaatgtgtactttacaatgtttacaaggagcttctctggtttgttatcccagcaatgcccttggtgagagcttcattctgcatttgtttaattcatatgctttgcttttggcatatgcttgctttttgcactagtagaattttaacttacctcattattatgtttgtaatcatttgtctagcttctgtaatgtatctgatataggctaaacaaatacttaaccaaagttaaaatacatggtaagcaattttgcacatattaaatattagggtttgttgtgtatatgtgtatacttaattataaaagaatatgaatggaaagttatactaaaagtatatgtttcaagcccagttattttaaagatctattgctttaatagaaaaagtttggcttttaaccctttcttctctgcattaattaacaacgtgcatcttgaagcccttctcctgataacaaggaataagttgattttaagcaaaggatagaatatttgtttgagtgtgcacatttatacctgtttagtatttgattcagttaagcctccactcttctggatcaggaggtgattctgaacctgtggttctaacatatgacttaactgtttagagggaagagaagtctttctatactgagggatttgttaaaatcataaatgtttttgccctgagacttagcccagattctattttttttttttttttggcatttgtacattaagcaccagtcatatttatctctgtgataagggattgctgactaaaaaatgccattaagaaatctctgtggctttgacattagtagttaataagagatcttagagctgtgtgctgatgaatagaatgaattggagcaaatagcaagagaagtgcatttagcttcttatgatttgcacattttctaaatgaagatccctttgtgtagcagtaggctgtatcatgcagatatttttcataggatttgcactgagttaaatgactttctttactcttcccagtcaggtaagcagttcaaatataacaagactttgtgccagtcctcttctgtgttctgcaactctggctctcataagtagtaaaaatatttttgatgttgcatgctctcagaattatgttttctaaaatatcatattggcttcattttagtttaataaacttctttggcaacttaattagacatagggtatatataaactcaattttatctgcattttttaaaaaattgaaataatctgattgcatgtatgaaggactcctgcctcattacccaattacataaatacaattatctataggaaggtgaaattgttgatctattatttcaaagacttgtagactagcaaagattcattctgattagaaataaggtctatagctaaagatatttttattttaaaaaattacagcccttgtaacaaaaatcatttgtaacattggatatgaagacattattagtatttaaaattattgtagtcatttgatcataaatgaagtagcttgcaaaatagacttggtctttgaccctttaaggtgtaactgactgactgttgtgtttttcaagactgattttaggcagttttatgtatcgtgtaccaatgatatgtaaaataaagcaccttttctactataaacaaaaaaaaaaaa

SEQ ID NO: 362 - DNA, 2519 bp, Homo sapiens
gaagtcggcgtcttgagtcataggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggatatgaactacattatccaaaggaagaaagaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacacactcgggcacttcaggaggtcagttctcaccccttcctcgatggggctttaaagctctggggagaagagctgctccccactcatgccccagagggactgtgaaaaggcttcctgtgacctccgatggcggcccctcattggccaagggcactgtggatgttttgtgggaggcagcatggcaccgtggaaagggcagtagacgtggagccggcacctctggtctggattccacttaaaaccagttgagtggtctcaagcccttaacctctgtaagcctgtttcttctctgaaatcacagtaataaagcgtcgtaagatggttgggaagaaccagaggtgacttatgcaaaagctttataaactgtaaagttcctgcca

SEQ ID NO: 363 - DNA, 2091 bp, Homo sapiens
gagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcacctggggtccaaatgcaggcgattcctgaggacgccatccctgaggagagtggcgatgaggacgaagacgaccctgacaagcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttct

SEQ ID NO: 364 - DNA, 6656 bp, Homo sapiens
agtggatgcgctcacctccctgcggcctcctgaggtggtttggtggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttggattatcttttgtctgtttattactacaatatgaagtcttgtttcagtggctaatgacatcatttctgtagacttacaatacactctaggtgaaagataatgattacagcttgaaagataactatttgctgtttctttgggaagagtatttatagtaattattacttatctttgcaatagaaattctaccaccttgccctctatagcttagccagttagtatcagtgaagattaacatcccattacaatttatgaaataatacagactctgcaattgagatgtaggagttctttgagttgacccaaagattctcaaaattgaaatggaaattctgaattgaaagaagaaactgaccagaacttgtattgaccagacttgcctatagtatattgctggtttaaaatggaacctgcagacaaaacctgtttcttttactgcatttacatggcatccaggttccattattatttacgtgacatccaggtttctaactcaaggaaataaacacaactgatttatcattcagcaactacttattgtgtgtctgcccattttaagactgtaggagtgtaactgaatataatggaaaaatgctttcactcagagcttacactcagagcttacattctagtagcaggaagcagacaaatgggggtaactcctgctactaagatgtgcaaagaagacaaaacattttaggaacttgccaaaatcagtgaaatctccctttttgtcaggcccacattgattcttttgagattaaaaattacagaatgccagaagataattcagtcaaaagtatttctcttcagtgcagtaaaatattaaaagaaaaaatatttctctacaagcctcttaaatgtttcagacattcacaatagcacctagacttttgtaatgaacagctgtgcacccaccccgacttaacaaatattttacttttgctatatttgcttcggtgtttttttcttaaaatacaccgaaattgaagctctctttgtgtactttgtcgtttgtaatcctccctccctcccagccttaagaagtaatcaccattgtgattattttatccatgtttttgtgaatattttacccatgtttttgtacttttgctacatatttgttatcaatctgtaaacctttatgacattaggaactaagaaacttagtcccttcgttagggggataatgaaatgtatttagtgtttgtgaaacatagatggtatgtatttggacaattctgtaactttgctttttttatttttatttttccatagcttattggggaacaggtggtgtttggttacatgattaagttctttagtggtgatttgtgggattttggtggacccatcacccaagcagtgtacactgcaccctatttgtaatcttttatccctcgcccccctcccaccatgcctcccgtctaccatgatgatcctgttttaaataagaaaataccatttcgcaggctccagatgttctggcatcctccctgtggatttcccagtgcctgcagctcacaggacaacaggggctgtggtagagtcacctatgagatcctggagtagtggatggaggagatggaacagtgaagacggaaactgagctcagtatccgggtgccaggagacaaaggccctttgctttttttcatttaatattctgatctacccctgttgacacatgttaagtatagttcattttgactgctatgtattatgttccattgtgtgaacatactgaaattgtacacttcaatactatactggatctccttgggtgtatttaagaggttttgtttttctaagtagttggttatatacaactaaaacctcaagagaactatctaaagcaatttcagcaaggtgatttggtacagcattaataaacagaaatcagtaacacttagtgaccaagtctgttggaagaacaaagacccccatttgtaataacaaaatttttagaaataatatgtaaagaagctatggttcttgtgtctagtaaggtcaatgtaacatagtaagatgtcagaataccctaatactttaaaaaattcatataggataaaaatgatatttgaaattggcaaggaaagacattattttgtaagtggaattgggacaacaactggtaaccaaatggaaaacccagttttctgccctccactagaagatttaaataggaaaagataaaactaccaaaaacctaaactcttaaagcaaatggattgaagaaggcctaagtgtgacaccaaactcaactataaaagatatatttgataacaaaaaaaaaattagttcagtggaccaacaaaaacttagaagacaagtcaagaaaaatgacaaaagacagagtgggaggcagatttgtaactcatccaggtcaaaaggctcatatctaaagatagtagaggaacaaaatgtataaggatgtgaactgggaaacaaatacatataaatagtttgtaaatatgaaaagatctttaacctcagtaaataaaaagctatagagagacttattttttaacttagttttttaaacctattatgtttatttattttttctttttttgagacggagtctcgctgttgcccaggctggtgtgcaatggcgcaatctcggctcactgcaacctccgcctcccaggttgaagccattctcctgcctcagcctcctgagtagctgggattacaggcgcctgtcaccacgcccagctaattgttcgcatttttagtagagacggggtttcactatgttggccaggctggcctcgaactcctgacctcatgatccacccaccttggccttccaaagtgctgggattacaggtgtgagctgccgcacctggctgtttatctcttttttttagagaaaggatctcggtcacccaggatggagtgtggtagcctgatcatatctcactacatcttagaacttctaggcttagggtattctcccacctcagcctcccaagtagctgggactacaagtgtgcaccatcacacctagctgatttttacatttttattttggagagatggtgtctccctgtgttgcccaggctggtcacaaactcctaggctcaagcgattctcctgactcaggcatgagccaccgtacccggcctaaacctatcatgttacagacttagaaagcaactattgtcaagtgtttgaggaaactcaggtcaggtttggtaaactaagatattaactcaagtaaagctctttaattcatttaatgaaggtgccacattgtctcagttctctatggcatgggtgaatgctgttctaagtcagcattggtactctaagctagttacatcatatctaagctttgcccttctaccagagctgctagcattctgtcaatgggcaattatttgaagttcttacattgaagttagtcacctacatcttctgttttttatggttttgatgtagtaatactgctgaagtttttttgataactgcgattcataatatttgttattcatattgtgatataaatgataagggcttttgaaaacaagtagtaatcatttcaatagcttaggatctccaccataatcttaggaaaattactaacctctgtgcctcagttgcttcatcatttaaaatgaggaaaataatagtccctacttaataggtttgttgtgaggattgagttaataacatagttaatgctcagtaagggttagctgctatttttttttcttttttttttgaaagagtctcactctgttgcccaggttggagtgcagtggcatgatcttggctcactgcatcctctgcttcctaggttcaggtgattctcatgcttcagcctcccaagcagctgggagtacaggtgtgcaccaccacacctggctaatttttgtatatttagtagagacgggttctcaccatattgtccaggctggtcttgaactccttacctcaaatgatccacccgcctgggcctcccaaagtgctgggattacaagcatgagccaccgcgcctggcttgctattgttatgaggtaaaggtagatagatgggtgagagtggtgccaggggaagtgttaaatttttgagtgttcctttagatgccagatgggttgtatctgagccttttattgcagtttgatgcctactagtgtgaagactactaggtcatagtggatagagaagcaatcttttggagacctgattttagcaaggatacgaataatatttgacaactttggggggatcttgatgcctctgtaatttactcaaggataatctcaagaaaaatggcattaagtagattacagaaaaaatagaactatcatattgttattattggctatttacatgagcaatgcggagaaatgtttaggattacagcatttagaagcttctcaattgctgcatttcctcactgtaccacaagatggcagatactgcatttaaaatttttttttctgtgtgttttctcttatagtcacttggtggccatgtaacaagcagagcaacatgtattaacagattctttttgaatgcaatattggattaaaaactttgaattaaactacaa

SEQ ID NO: 365 - DNA, 8980 bp, Homo sapiens
ggaggttgtggggccgccgccgcggagcaccgtccccgccgccgcccgagcccgagcccgagcccgcgcacccgcccgcgccgccgccgccgccgcccgaacagcctcccagcctgggcccccggcggcgccgtggccgcgtcccggctgtcgccgcccgagcccgagcccgcgcgccggcgggtggcggcgcaggctgaggagatgcggcgcggagcgccggagcagggctagagccggccgccgccgcccgccgcggtaagcgcagccccggcccggcgcccgcgggccattgtccgccgcccgccccgcgccccgcgcagcctgcaggccttggagcccgcggcaggtggacgccgccggtccacacccgccccgcgcgcggccgtgggaggcgggggccagcgctggccgcgcgccgtgggacccgccggtccccagggccgcccggccccttctggacctttccacccgcgccgcgaggcggcttcgcccgccggggcgggggcgcgggggtgggcacggcaggcagcggcgccgtctcccggtgcggggcccgcgccccccgagcaggttcatctgcagaagccagcggacgcctctgttcaacttgtgggttacctggctcatgagaccttgccggcgaggctcggcgcttgaacgtctgtgacccagccctcaccgtcccggtacttgtatgtgttggtgggagtttggagctcgttggagctatcgtttccgtggaaattttgagccatttcgaatcacttaaaggagtggacattgctagcaatgagctcccaaagccatccagatggactttctggccgagaccagccagtggagctgctgaatcctgcccgcgtgaaccacatgcccagcacggtggatgtggccacggcgctgcctctgcaagtggccccctcggcagtgcccatggacctgcgcctggaccaccagttctcactgcctgtggcagagccggccctgcgggagcagcagctgcagcaggagctcctggcgctcaagcagaagcagcagatccagaggcagatcctcatcgctgagttccagaggcagcacgagcagctctcccggcagcacgaggcgcagctccacgagcacatcaagcaacaacaggagatgctggccatgaagcaccagcaggagctgctggaacaccagcggaagctggagaggcaccgccaggagcaggagctggagaagcagcaccgggagcagaagctgcagcagctcaagaacaaggagaagggcaaagagagtgccgtggccagcacagaagtgaagatgaagttacaagaatttgtcctcaataaaaagaaggcgctggcccaccggaatctgaaccactgcatttccagcgaccctcgctactggtacgggaaaacgcagcacagttcccttgaccagagttctccaccccagagcggagtgtcgacctcctataaccacccggtcctgggaatgtacgacgccaaagatgacttccctcttaggaaaacagcttctgaaccgaatctgaaattacggtccaggctaaagcagaaagtggccgaaagacggagcagccccctgttacgcaggaaagacgggccagtggtcactgctctaaaaaagcgtccgttggatgtcacagactccgcgtgcagcagcgccccaggctccggacccagctcacccaacaacagctccgggagcgtcagcgcggagaacggtatcgcgcccgccgtccccagcatcccggcggagacgagtttggcgcacagacttgtggcacgagaaggctcggccgctccacttcccctctacacatcgccatccttgcccaacatcacgctgggcctgcctgccaccggcccctctgcgggcacggcgggccagcaggacgccgagagactcacccttcccgccctccagcagaggctctcccttttccccggcacccacctcactccctacctgagcacctcgcccttggagcgggacggaggggcagcgcacagccctcttctgcagcacatggtcttactggagcagccgccggcacaagcacccctcgtcacaggcctgggagcactgcccctccacgcacagtccttggttggtgcagaccgggtgtccccctccatccacaagctgcggcagcaccgcccactggggcggacccagtcggccccgctgccccagaacgcccaggctctgcagcacctggtcatccagcagcagcatcagcagtttctggagaaacacaagcagcagttccagcagcagcaactgcagatgaacaagatcatccccaagccaagcgagccagcccggcagccggagagccacccggaggagacggaggaggagctccgtgagcaccaggctctgctggacgagccctacctggaccggctgccggggcagaaggaggcgcacgcacaggccggcgtgcaggtgaagcaggagcccattgagagcgatgaggaagaggcagagcccccacgggaggtggagccgggccagcgccagcccagtgagcaggagctgctcttcagacagcaagccctcctgctggagcagcagcggatccaccagctgaggaactaccaggcgtccatggaggccgccggcatccccgtgtccttcggcggccacaggcctctgtcccgggcgcagtcctcacccgcgtctgccaccttccccgtgtctgtgcaggagccccccaccaagccgaggttcacgacaggcctcgtgtatgacacgctgatgctgaagcaccagtgcacctgcgggagtagcagcagccaccccgagcacgccgggaggatccagagcatctggtcccgcctgcaggagacgggcctccggggcaaatgcgagtgcatccgcggacgcaaggccaccctggaggagctacagacggtgcactcggaagcccacaccctcctgtatggcacgaaccccctcaaccggcagaaactggacagtaagaaacttctaggctcgctcgcctccgtgttcgtccggctcccttgcggtggtgttggggtggacagtgacaccatatggaacgaggtgcactcggcgggggcagcccgcctggctgtgggctgcgtggtagagctggtcttcaaggtggccacaggggagctgaagaatggctttgctgtggtccgcccccctggacaccatgcggaggagagcacgcccatgggcttttgctacttcaactccgtggccgtggcagccaagcttctgcagcagaggttgagcgtgagcaagatcctcatcgtggactgggacgtgcaccatggaaacgggacccagcaggctttctacagcgaccccagcgtcctgtacatgtccctccaccgctacgacgatgggaacttcttcccaggcagcggggctcctgatgaggtgggcacagggcccggcgtgggtttcaacgtcaacatggctttcaccggcggcctggacccccccatgggagacgctgagtacttggcggccttcagaacggtggtcatgccgatcgccagcgagtttgccccggatgtggtgctggtgtcatcaggcttcgatgccgtggagggccaccccacccctcttgggggctacaacctctccgccagatgcttcgggtacctgacgaagcagctgatgggcctggctggcggccggattgtcctggccctcgagggaggccacgacctgaccgccatttgcgacgcctcggaagcatgtgtttctgccttgctgggaaacgagcttgatcctctcccagaaaaggttttacagcaaagacccaatgcaaacgctgtccgttccatggagaaagtcatggagatccacagcaagtactggcgctgcctgcagcgcacaacctccacagcggggcgttctctgatcgaggctcagacttgcgagaacgaagaagccgagacggtcaccgccatggcctcgctgtccgtgggcgtgaagcccgccgaaaagagaccagatgaggagcccatggaagaggagccgcccctgtagcactccctcgaagctgctgttctcttgtctgtctgtctctgtcttgaagctcagccaagaaactttcccgtgtcacgcctgcgtcccaccgtggggctctcttggagcacccagggacacccagcgtgcaacagccacgggaagcctttctgccgcccaggcccacaggtctcgagacgcacatgcacgcctgggcgtggcagcctcacagggaacacgggacagacgccggcgacgcgcagacacacggacacgcggaagccaagcacactctggcgggtcccgcaagggacgccgtggaagaaaggagcctgtggcaacaggcggccgagctgccgaattcagttgacacgaggcacagaaaacaaatatcaaagatctaataatacaaaacaaacttgattaaaactggtgcttaaagtttattacccacaactccacagtctctgtgtaaaccactcgactcatcttgtagcttatttttttttaaagaggacgttttctacggctgtggcccgcctctgtgaaccatagcggtgtgcggcggggggtctgcacccgggtgggggacagagggacctttaaagaaaacaaaactggacagaaacaggaatgtgagctgggggagctggcttgagtttctcaaaagccatcggaagatgcgagtttgtgcctttttttttattgctctggtggatttttgtggctgggttttctgaagtctgaggaacaatgccttaagaaaaaacaaacagcaggaatcggtgggacagtttcctgtggccagccgagcctggcagtgctggcaccgcgagctggcctgacgcctcaagcacgggcaccagccgtcatctccggggccaggggctgcagcccggcggtccctgttttgctttattgctgtttaagaaaaatggaggtagttccaaaaaagtggcaaatcccgttggaggttttgaagtccaacaaattttaaacgaatccaaagtgttctcacacgtcacatacgattgagcatctccatctggtcgtgaagcatgtggtaggcacacttgcagtgttacgatcggaatgctttttattaaaagcaagtagcatgaagtattgcttaaattttaggtataaataaatatatatatgtataatatatattccaatgtattccaagctaagaaacttacttgattcttatgaaatcttgataaaatatttataatgcatttatagaaaaagtatatatatatatataaaatgaatgcagattgcgaaggtccctgcaaatggatggcttgtgaatttgctctcaaggtgcttatggaaagggatcctgattgattgaaattcatgttttctcaagctccagattggctagatttcagatcgccaacacattcgccactgggcaactaccctacaagtttgtactttcattttaattattttctaacagaaccgctcccgtctccaagccttcatgcacatatgtacctaatgagtttttatagcaaagaatataaatttgctgttgatttttgtatgaattttttcacaaaaagatcctgaataagcattgttttatgaattttacatttttcctcaccatttagcaattttctgaatggtaataatgtctaaatctttttcctttctgaattcttgcttgtacatttttttttacctttcaaaggtttttaattatttttgtttttatttttgtacgatgagttttctgcagcgtacagaattgttgctgtcagattctattttcagaaagtgagaggagggaccgtaggtcttttcggagtgacaccaacgattgtgtctttcctggtctgtcctaggagctgtataaagaagcccaggggctctttttaactttcaacactagtagtattacgaggggtggtgtgtttttcccctccgtggcaagggcagggagggttgcttaggatgcccggccaccctgggaggcttgccagatgccgggggcagtcagcattaatgaaactcatgtttaaacttctctgaccacatcgtcaggatagaattctaacttgagttttccaaagaccttttgagcatgtcagcaatgcatggggcacacgtggggctctttacccacttgggtttttccactgcagccacgtggccagccctggattttggagcctgtggctgcaaggaacccagggacccttgttgcctggtgaacctgcagggagggtatgattgcctgaccaggacagccagtctttactctttttctcttcaacagtaactgacagtcacgttttactggtaacttattttccagcacatgaagccaccagtttcattccaaagtgtatattgggttcagacttgggggcagaagttcagacacaccgtgctcaggagggacccagagccgagtttcggagtttggtaaagtttacagggtagcttctgaaattaactcaaacttttgaccaaatgagtgcagattcttggattcacttggtcactgggctgctgatggtcagctctgagacagtggtttgagagcaggcagaacggtcttgggacttgtttgactttcccctccctggtggccactctttgctctgaagcccagattggcaagaggagctggtccattccccattcatggcacagagcagtggcagggcccagctagcaggctcttctggcctccttggcctcattctctgcatagccctctggggatcctgccacctgccctcttaccccgccgtggcttatggggaggaatgcatcatctcactttttttttttaagcagatgatgggataacatggactgctcagtggccaggttatcagtggggggacttaattctaatctcattcaaatggagacgccctctgcaaaggcctggcagggggaggcacgtttcatctgtcagctcactccagcttcacaaatgtgctgagagcattactgtgtagccttttctttgaagacacactcggctcttctccacagcaagcgtccagggcagatggcagaggatctgcctcggcgtctgcaggcgggaccacgtcagggagggttccttcatgtgttctccctgtgggtccttggacctttagcctttttcttcctttgcaaaggccttgggggcactggctgggagtcagcaagcgagcactttatatccctttgagggaaaccctgatgacgccactgggcctcttggcgtctgccctgccctcgcggcttcccgccgtgccgcagcgtgcccacgtgcccacgccccaccagcaggcggctgtcccggaggccgtggcccgctgggactggccgcccctccccagcgtcccagggctctggttctggagggccactttgtcaaggtgtttcagtttttctttacttcttttgaaaatctgtttgcaaggggaaggaccatttcgtaatggtctgacacaaaagcaagtttgatttttgcagcactagcaatggactttgttgtttttctttttgatcagaacattccttctttactggtcacagccacgtgctcattccattcttctttttgtagactttgggcccacgtgttttatgggcattgatacatatataaatatatagatataaatatatatgaatatatttttttaagtttcctacacctggaggttgcatggactgtacgaccggcatgactttatattgtatacagattttgcacgccaaactcggcagctttggggaagaagaaaaatgcctttctgttcccctctcatgacatttgcagatacaaaagatggaaatttttctgtaaaacaaaaccttgaaggagaggagggcggggaagtttgcgtcttattgaacttattcttaagaaattgtactttttattgtaagaaaaataaaaaggactacttaaacatttgtcatattaagaaaaaaagtttatctagcacttgtgacataccaataatagagtttattgtatttatgtggaaacagtgttttagggaaactactcagaattcacagtgaactgcctgtctctctcgagttgatttggaggaattttgttttgttttgttttgtttgtttccttttatctccttccacgggccaggcgagcgccgcccgccctcactggccttgtgacggtttattctgattgagaactgggcggactcgaaagagtccccttttccgcacagctgtgttgactttttaattacttttaggtgatgtatggctaagatttcactttaagcagtcgtgaactgtgcgagcactgtggtttacaattatactttgcatcgaaaggaaaccatttcttcattgtaacgaagctgagcgtgttcttagctcggcctcactttgtctctggcattgattaaaagtctgctattgaaagaaaaagaaagcgaacagtttttgtttgttttttttgccgtgtgtgctccatagtggaggcgctattttccaattgatgagaatgacaaacatatataatctatctatctatctatctatctatctatctatacagggggcttgaaccttactcacccaagagcttcttacggaatgtggtagaaaaccaagttgtaacgacactgtaacctacctgatgcctgttcgcgcccgccgtgagctgcgcactggccgtggccaccattcacctctgtaatttaatccgtttctcttggattgtctggacgtgcccgatggttctttcttttgctcagtggagttggaggttttgtgtttggttttctcattcttgtcttgttttgtgtgggtggattttcaccgaccaatgatatcctcttctgacggtcaccttctttccacttcactggagtccagtattctgtaccacatcacgcaacgtgttatcttgtggtgtaaataaagactgcgttacttgccctcccaaaaa

SEQ ID NO: 366 - DNA, 2064 bp, Homo sapiens
aaatggccccgtagggcaacaaggatggttagttttgaccctacttatttgtgccataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattatgtgctggaaatcacgccaagctgccggccagaccgcaatgagccccaccgaatccaacaaatcctcaactacatcaaagggaatctgaagcatgtggtctagttgacagaaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaagaaggagatatcccacatttaaagttcttatttaaaaaaacacacacacacaaatgaaatttttaatctttgaaaattatttttaagcgaattggggaggggagtattttaatcatcttaaatgaaacagatcagaagctggatgagagcagtcaccagtttgtagggcaggaggcagctgacaggcagggtttgggcctcaggaccatccaggtggagccctgggagagagggtactgatcagcagactgggaggtggggagaagtccgctggtgttgttttagtgttatatatctttggtttttttaataaaatctttgaaaacctaaaaaaaaaaaaaaaaaaaaaaaaaaaaaaaaaaaaaaaaaaaaaaaaaaa

SEQ ID NO: 367 - DNA, 4273 bp, Homo sapiens
actcgtctggcaccagcccgggccgcgcccgggacctcatttcggacctcggtttccctttgcgtggggctcgcagctgccaccgcttccccgcggagcatggggctgcctcgccgggcaggggacgcggcggagctgcgcaagagcctgaagccgctgctggagaagcgccggcgcgcgcgcatcaaccagagcctgagccagcttaaggggctcatcctgccgctgctgggccgggagaactccaactgctcgaagctagagaaggcagacgtcctggaaatgaccgtgcgcttcctgcaggagctgcctgcgtcctcatggcccacggcagcgcccctgccttgcgacagctaccgcgagggctacagcgcctgtgtggcgcgcctggcccgcgtgctgcccgcctgccgtgtcctggagcccgccgtgagcgcgcgcctgctggagcacctgtggcggagagcggccagcgccaccctggacggcgggcgcgctggggattccagtggcccgtctgcccccgccccagcgcccgcgtctgccccagagcccgcatccgctccggtgccctcgccgccctcgcctccctgcggccctggcctctggcggccgtggtagcccctcggccgatccacagaccctgccgactgcttgggaccttggggcactggacaggttgaagctcttggtggcggctgctgttcccatcattaggggccagcccagtacccacacccaggccggaagccggctgtttgtgactggcgtggcagactgaaagccctggggctggggctcggctcagggaataaaaggagcgtccctgcttcacccccaacttggctggagaagaaaggacaagaggcagcagggtgaagaagaagccccccatcccagctggtggagatagttctggaactggaccccgcagctgcgtgggcagccgacacacccaccccagcactggcaccagaccagagccagagccaggacctgggcaaagtgcagccgtgcaccctgcctggtcactgctctcccagccctgcctgggcctacctcctgcccagctctgcttgggaccctctgggcatgcagcagcagtagcctaagggctctggtcacttccagggctctacagggcagcagagcagagcaaaagggtgcatatgctgggagctgtcacctccactcctaggcttttctgcctagagcagaattataggggcagtatacatccaggggtctgtgcggtggggctgggggattccttaagtgactttgggaaggatttgttttcccgagcatcaatttcacacctgggcattgcaccccaggctatgcagtctttcagtgtgaggaaggggcagaacaagaatgaggcggccccgtggcctcaaggaagcttgtggctttggaggatctgactccagcagagtctgtgccaatgtggggtgagcagggcccctgccatggagcagcaggaatttgagggatggagcaggttaaagaatgggaaacatcttcacttgtttttttttcttgcaaactactccctgctactcattgagactggttactggaagcaacttgttaagatttttctttctgggcgggcgcggtggctcacgcctgtaatcccagcactttgggaggccaaggcgggtggatcacctgaggtcaggagttcgagaccagcttagccaatatggtgaaaccccgtctctactaaaaatacaaaaattagccgggtgtggtggcatgtgccagctactcgggaggctgaggcaagagaatcacttgaacctcggaggctgaagttgcagtgagccaagattgagccattgctctccagcctgggtgacacagcaagactctgtctcaaaaaaaattttttatttctttcttttccatggaggcctagagtccctgtgaaggctaggaaggggctgctgatcccaggagtgcccacgaggagtggggggcactgttggcccataatcaggcaaacacccatcatttcatgggggattcatgaaatcatagtcaggcaaacacccgtcatttcatggctaagcatttgcagaaggtggaggattctcccccgagtccccaaatcagcagcctgtgctagggaccagagcaccgggggcaagaagacagaaccaatgtgggagtggggatggtcactaaatctgactgtgccacacaagcccatgatgaccttggcactggtttgggtggcaggatatgaaggaagctgtaggcattattgaaaaaatcattgttcagccaacagggtgaggctcccagcaaggccgtgccatcttcccacctccctgtgcccagagggttagactgtaagctcccggagggcgaggctggggctgagcgtgcctccacgtccccaaggcacagggtgcacagtgggtgctcactgaatatagtggactagtgagcagaggatgagaggactaccctgtaatgagccttggacagtctggcatttgccttaactcccactcccatgccctgggatcactgttggatatttactccatgaggacaaatactggggaggtgtggagaggagggagggcaggttcctcttactttcacccattgctgagaatgagcgcctgttggcactgcctttgtgagcctccgggagcaggtaacctgcggcccaagcccgcctaggactccacatcaggcaggcacaggactggccccttgtcctcataaaaactctcagtacagcttaaactctgtaagatctaaccagccaggaggaccctcgcttcctctccgccatgcttgccacctcttgcttctgagagtccatctcagttcgcagttctgtgacttgcattgacctggctccaatcaagctacaactcaagcagtcacggggagaaggattgtagatgggccagtgactcacagggtcaggcactcgggggagcctgagtcaggaggtcagtgggccctggaagggagggggcaagcctgggtgggtaaggttctgggccccaggcaagaaggcagagtttctccgcaggggtgtgtgcaagagctagctgcgcagaaggtctccgctggctctccaagccgggcttgtgaaataggaacgccaacatcctcctccacaggcagtggcaggcacctcctcctcaggtgccccccaagccctatctgatgggcaaaggtgaacgcagggcggtgggcttttcctgtgcagagggagactgattcaaagggtcatttatgacctttcacaagtcccacatcctgcccaatggccaggtcttgggatgctgttgcaagatggttctgtgactccatgtgactgtctgatgattgccccagctggggaaaaggctcccatgtctctttctcataaaaccagtgggcaaggccgggcgcagtggctcacgtctgtaatgccagcacttcgggagaccaaggtgggcggatcacctgaggtcaggagttcaagaccagcctgaccaacatggtgaaaccccgtctctacaaaaatatggaaattagctgggcatgacggcgggtgcctgtaaccccagctacttgggaggctgaggagggataatcagttgaacccaggaggtggaggttgcagtgagccgagatcgcgccactgcactccagcctgggtgacagagcaagactccatctcaaaaacaaacaaacaaaaaactagcgggtgaaatgattcagtgacctaaggacagccagagcactaagctgctgggaacccatctgtgctgaaatgtagatttcccaggaaactcaggcttgggacaggcgcctacctgctcctcgggcaccaggtgattaggagaggtcgaatctcatttccacgtgagtgaggataaagactgggctgccaaggaggactcctcataaacattgacaaattgctctgccccgcctgtgatcccagacgactcctgcagtctgggatcctgagtgtcctgtgggttcatctcggatgggcgctgcataaacagcctgcagggaacgtctgggagaaccagcttcacaacagatataataaggaagaagtttgaaatattgcaagaattgcgaaagtgtgacacacagatacaaagtgggcacatgctcgtgggaaaatgttgccaatagacttgcttgactctggagttaccccgaaccttcaatttgtttaaaaaaaaaaaaaggcaatatcttgacgtgcaataaagtgaactgcaataaaaaaaaaaaaaaa

SEQ ID NO: 368 - DNA, 992 bp, Homo sapiens
gcgcttggccttgcccgcgcccgctcgcctcgtctcgcccggcctccccgcgtcgcctcgtcgcctgttccgcgccaggcatggcccccagcactgtggccgtggagctgctcagccccaaagagaaaaaccgagtaagtaccagactcgcccggcgcgctgtccccgcggcctccggtcctcgggggtccctgcgccgtgccgggccagcctgacaccccctcctcccgcagctgcggaagccggtggtggagaagatgcgccgcgaccgcatcaacagcagcatcgagcagctgaagctgctgctggagcaggagttcgcgcggcaccagcccaactccaagctggagaaggccgacatcctggagatggctgtcagctacctgaagcacagcaaaggtgagcgcgcccgggccccccgcgccccgagttcccaccgcgccccggctcccccgcgccccgccggccgctcaccgccgccgcgtctccccgcagccttcgtcgccgccgccgggcccaagagcctgcaccaggactacaggcgaaggctactcgtggtgcctgcaggaagccgtggaagttcctggacgcttcccacgcccgccaggcgaacacgcaggattgaagactggctggtaaccccctttccaggcggggccccccgggggcgggggacctcggcccgggggcccggcccaaagggagccccaaagggggggccggggggcgcccggaggcccccccgggcccggggggttcttcccgcccaaggggcgaacccgtcgcgcgccgccgggcctgtccccgggaacaccaatccccaggccctgggggggcgctttttggcgggggacccctgggggggacccgcgggggggataataccggggggcttaaccgcgggcgcctgacccgaatcccgcggggggcggaaagcggggcgccccgttcccccgcttgggccactgtagaaaacgcacctatccccccca

SEQ ID NO: 369 - DNA, 1386 bp, Homo sapiens
ggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaaaaaaaaaaaaaaaaaa

SEQ ID NO: 370 - DNA, 1684 bp, Homo sapiens
gaggagcaatggtcacccgggatcgagctgagaatagggacggccccaagatgctcaagccgcttgtggagaagcggcgccgggaccgcatcaaccgcagcctggaagagctgaggctgctgctgctggagcggacccgggaccagaacctccggaacccgaagctggagaaagcggagatattggagttcgccgtgggctacttgagggagcgaagccgggtggagcccccgggggttccccggtccccagtccaggacgccgaggcgctcgccagctgctacttgtccggtttccgcgagtgcctgcttcgcttggcggccttcgcgcacgacgccagcccggccgcccgcgcccagctcttctccgcgctgcacggctatctgcgccccaaaccgccccggcccaagccggtagatccgaggcctccagcgccgcgcccatccctggaccccgccgcaccggcccttggccctgcgctgcaccagcgccccccagtgcaccagggccaccctagcccgcgctgcgcatggtccccatccctctgctccccgcgcgccggggattctggcgcgccggcgcccctcaccggactgctgccgccgccaccgccgcctcacagacaagacggggcgcccaaggccccgctgcccccgccgcccgctttctggagaccttggccctgagccttggggggtggtgggggcggggtctaggggtggggtagagactccagcccgagggcagcagagggacccgggcgtccgggcgagcaggtgttggggagggcagtggggcgcgcgggctcagcgcgcgggtgagatgtggtctatattagagtatctatataaatatatatttccctggttcctgtcccttttccctgccccaacttctcccttgcgtctaggattgtactctctctgcccctcagcccagtcccagtcccttcccgagtccctagtgcatggaataaagtggttattaaatccccgtgtgtccccgagccaggggcctgcctttatctcgacgtccacgcccactttcccttcccttctgtctcccaccctcagtcctgctctccatggcccaagccccggggcagacaggtaagtaaagaagagagcagagcgggaactgagatcgaaattgaaaccaggtggaaagagagagatagggtagggggagaagggatgggggcctttaagaaaaaaacggataaaaaggaaaaattgaaataaaatcgactctggtgggattcgaacccacaacctttgaattgctctattcgtcactagaagtccaatgcgctatccattgcgccacagagccacccgacgaacggcggcgtcttgtagcttacgggtactagagtgggaatggggcagggttggggagcggggctaagggacttgggcgggacatgccaggagggcgcggtttggatctcagaggccaagccaggtagaggtagcgggcgcaaagcatgttagccaggtgagagagagggcgcacatgggtcgaaaaaacagggagggagagcaaccgaaaatggctgagcgagcgagtgcagagctccggctgcccgcttggggggtgtttccggctcaggcgctccccactcccagatatagtcccacccaaataaactagttttgttgtaaattaaaaaaaaaaaaaaaaa

SEQ ID NO: 371 - DNA, 1182 bp, Homo sapiens
ccacatttgtgcatcacttctttagagaaagttaagtctgtgttctgcttaggagagataacactttttgtccctgtaggtggcccccctggtgtagccattagttgctaattacttgcaaacaaataaacaattaactccttaagctgctggctgggcaagtgttcattgacatgctaaaactttctaagacaggattttaattagtgacgttctaaatccagcccccttgtcagcggagctataaggtgaactgcaggaagatcccagccctatacacgtggggcagagccagcagaggccagagctgttgctctgtgcagaccacgagaggatgtctcccagccttcaggaaggcgctcagctcggggaaaacaaaccctcaacttgctccttttcaattgagagaatcttaggactggaccagaagaaagactgtgttccattaatgaaaccccacaggccctgggcagacacctgcagctcatcagggaaagatggtaacttatgtctacatgtcccaaatcctcccagtgggatttcattccctagcgtggtggatcacccaatgccagaagaaagagcttcgaaatatgaaaattacttttcagcctcagaaagactgtctttgaaaagagagttgagttggtatagaggccgaagaccaagaactgcttttactcaaaaccagattgaagtgttagaaaatgtctttagagtaaactgctatcctggtatcgatattagagaagacttagctcaaaaattgaatctagaggaagacagaatccagatttggtttcaaaatcggcgtgcaaaactgaaaaggtcccatagagaatcacagtttctaatggcgaaaaaaaatttcaacacaaatctgctggaatagatagaaaactaaacaagtgaaattatcttctaattgcagagcatgaagaatcagtggaaatattaagtgttaaaatgtgatgttttctttcctgcatttaatctgaatattgtcattttttctgaaaatatattgtaaatactattatagcatggtacatatttgggcacttttagttatagtaaagaccttttatatatattttaataaacattttcagaaaagattgctattttttaagtaagccaaattaatctaataaattagtttgttaaaatcaaaaaaaaaaa

SEQ ID NO: 372 - DNA, 2319 bp, Homo sapiens
ttccccactcccccgccctccccagggccctgggaaggggctcagcgtgggaaaggatggttgagttttaaccagaggcaaagcgtgagcgggatcagtgtgtgcggaacgcaagcagccgagagcggagaggcgccgctgtagttaactcctccctgcccgccgcgccgaccctccccaggaacccccagggagccagcatgaagcgagctcaccccgagtacagctcctcggacagcgagctggacgagaccatcgaggtggagaaggagagtgcggacgagaatggaaacttgagttcggctctaggttccatgtccccaactacatcttcccagattttggccagaaaaagacggagaggaataattgagaagcgccgacgagaccggatcaataacagtttgtctgagctgagaaggctggtacccagtgcttttgagaagcagggatctgctaagctagaaaaagccgagatcctgcagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaaactgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaagtaaaaaaaaaaaaaaaaaaaaaaaaaaa

SEQ ID NO: 373 - DNA, 2672 bp, Homo sapiens
gcgtggccggcgccggctcttgcggccgagcagagttgcggcgtgggaaagagccgctaggagcagaccgcgccgccgccggagccgcgcctgcccaggcccggggagggaggaggcgggcgtcagggtgctgcgccccgctcggcgtccgagcttccggccgggctgtgccccgcgcggtcttcgccgggatgaagcgcccctgcgaggagacgacctccgagagcgacatggacgagaccatcgacgtggggagcgagaacaattactcggggcaaagtactagctctgtgattagattgaattctccaacaacaacatctcagattatggcaagaaagaaaaggagagggattatagagaaaaggcgtcgggatcggataaataacagtttatctgagttgagaagacttgtgccaactgcttttgaaaaacaaggatctgcaaagttagaaaaagctgaaatattgcaaatgacagtggatcatttgaagatgcttcaggcaacagggggtaaaggctactttgacgcacacgctcttgccatggacttcatgagcataggattccgagagtgcctaacagaagttgcgcggtacctgagctccgtggaaggcctggactcctcggatccgctgcgggtgcggcttgtgtctcatctcagcacttgcgccacccagcgggaggcggcggccatgacatcctccatggcccaccaccatcatccgctccacccgcatcactgggccgccgccttccaccacctgcccgcagccctgctccagcccaacggcctccatgcctcagagtcaaccccttgtcgcctctccacaacttcagaagtgcctcctgcccacggctctgctctcctcacggccacgtttgcccatgcggattcagccctccgaatgccatccacgggcagcgtcgccccctgcgtgccacctctctccacctctctcttgtccctctctgccaccgtccacgccgcagccgcagcagccaccgcggctgcacacagcttccctctgtccttcgcgggggcattccccatgcttcccccaaacgcagcagcagcagtggccgcggccacagccatcagcccgcccttgtcagtatcagccacgtccagtcctcagcagaccagcagtggaacaaacaataaaccttaccgaccctgggggacagaagttggagctttttaaatttttcttgaacttcttgcaatagtaactgaatgtcctccatttcagagtcagcttaaaacctctgcaccctgaaggtagccatacagatgccgacagatccacaaaggaacaataaagctatttgagacacaaacctcacgagtggaaatgtggtattctcttttttttctctcccttttttgtttggttcaaggcagctcggtaactgacatcagcaacttttgaaaacttcacacttgttaccatttagaagtttcctggaaaatatatggaccgtaccatccagcagtgcatcagtatgtctgaattggggaagtaaaatgccctgactgaattctcttgagactagatgggacatacatatatagagagagagtgagagagtcgtgtttcgtaagtgcctgagcttaggaagttttcttctggatatataacattgcacaagggaagacgagtgtggaggataggttaagaaaggaaagggacagaagtcttgcaataggctgcagacattttaataccatgccagagaagagtattctgctgaaaccaacaggttttactggtcaaaatgactgctgaaaataattttcaagttgaaagatctagttttatcttagtttgccttctttgtacagacatgccaagaggtgacatttagcagtgcattggtataagcaattatttcatcagttctcagattaacaagcatttctgctctgcctgcaggcccccaggcacttttttttttggatggctcaaaatatggtgctgctttatataaaccttacatttatatagtgcacctatgagcagttgcctaccatgtgtccaccagaggctatttaattcatgccaacttgaaaactctccagtttgtaggagtttggtttaatttattcagtttcattaggactatttttatatatttatcctcttcattttctcctaatgatgcaacatctattcttgtcaccctttgggagaagttacatttctggaggtgatgaagcaaggagggagcactaggaagagaaaagctacaatttttaaagctctttgtcaagttagtgattgcatttgatcccaaaacaagatgaatgtatgcaatgggatgtacataagttatttttgcccatgcctaaactagtgctatgtaatggggttgtggttttgtttttttcgatttcgtttaatgacaaaataatctcttaatatgctgaaatcaagcacgtgagagtttttgtttaaaagataagagacacagcatgtattatgcacttcatttctctactgtgtggagaaagcaataaacattatgagaatgttaaacgttatgcaaaattatacttttaaatatttgttttgaaattactgtacctagtcttttttgcattactttgtaacctttttctatgcaagagtctttacataccactaattaaatgaagtcctttttgacta

SEQ ID NO: 374 - DNA, 4131 bp, Homo sapiens
ccgactgggagccttagccgcggggctgagaccaggcagcctgcgttcgccatgaagcgacccaaggagccgagcggctccgacggggagtccgacggacccatcgacgtgggccaagagggccagctgagccagatggccaggccgctgtccacccccagctcttcgcagatgcaagccaggaagaaacgcagagggatcatagagaaacggcgtcgagaccgcatcaacagtagcctttctgaattgcgacgcttggtccccactgcctttgagaaacagggctcttccaagctggagaaagccgaggtcttgcagatgacggtggatcacttgaaaatgctccatgccactggtgggacaggattctttgatgcccgagccctggcagttgacttccggagcattggttttcgggagtgcctcactgaggtcatcaggtacctgggggtccttgaagggcccagcagccgtgcagaccccgtccggattcgccttctctcccacctcaacagctacgcagccgagatggagccttcgcccacgcccactggccctttggccttccctgcctggccctggtctttcttccatagctgtccagggctgccagccctgagcaaccagctcgccatcctgggaagagtgcccagccctgtcctccccggtgtctcctctcctgcttaccccatcccagccctccgaaccgctccccttcgcagagccacaggcatcatcctgccagcccggaggaatgtgctgcccagtcgaggggcatcttccacccggagggcccgccccctagagaggccagcgacccctgtgcctgtcgcccccagcagcagggctgccaggagcagccacatcgctcccctcctgcagtcttcctccccaacaccccctggtcctacagggtcggctgcttacgtggctgttcccacccccaactcatcctccccagggccagctgggaggccagcgggagccatgctctaccactcctgggtctctgaaatcactgaaatcggggctttctgagctgccccttcaccaccccgccccaaggaataaggaaggttcttttaccaggagcccaaaaaagggcactgccttttctgctttgcttcatggactggctcatatgtgaaggcacgttctccagccatcagaggccccctcctcctccaacccatctctccttctcactgttatcccagcttatccacccagctctcctggagctgttctggtctcagaggcttggttccatttctcacctgaacagatgagtcctgggagagaccctcagagatccgcccagacccctctcctgccctctgcacaccagcagcaggcatgaaccttgggtctgggaaaaagctttaacctgcagggcaccaggacccaaggcaggctgttccttggggcggtcagaccccagtcaggagcaatgactgactggctgcagccttcccacgccaagaggctggaacatagtgtctgcctcgcttcctggagatagtaactgagcaggggctacaaagaggtctcctgggaaccctgtctgccccttcccacctgtccttgggccacaccatcacactgaaccacaggacagaccctttctccaccacagccaaggcctggagactgggggcccagcagagcctgctcccaccctcctcccagcagcagacacccaccctctcactgactaacaggtccctgcacacagctggcctggtaaacccagctgggaggtttctaggcagcagcaaaactctgtgacagggtgtcctcacaccaggccttggacagctctcccagacaggagccagggttgagcaatggagagcccagcccccacgtcttacagtcgccatcctccaggcgtgtggtccctccccattgggtgcacagtgcagaggggccgtggccccatgtgatggtgcgcagagaggaacctcttgggattcagcaccagacgtctgtgctgcctggtttgcatccggctcacagagcccagactgctggaacagccaaggactgtcaggctggacaaaaataactgcaaggaggggcaagagaaaggatgattcgaggcaccttggcccttcaaggtcatgcagtgggtcgagcgcctgagatcctgttcaccaggactccacagagctggctctgctcagaagccatttcattccccggctccaccctaggccactttttctaacagaggaaacaaatggtccagcagtcgttcccagcagaacagcggagcctggactgacacccagtgggaccagtgttgccacaccagttgataaaatgcagaaacccttctgtactcgttggtaaatatctactcccccaagtgactccaggtgccccccaccgcctggcacttcccccaggactcctacgatctggttactgcctggccgatccaaggctgtggagtcccagagccagcagttcactggtgctcattccacactggttagatacttcagttgtcacccctgggaagattctcccacctcctccctttgatggaaccaccctccccagaggctgcattgaggagactccacagactgaaaagtgagtttgcagaaaccttggggaaaagggccctttcaaagaagtggataagagggaggagatcattgagtgacccagaaagctcttttgaaaagacagactcctcaaggagagataaagaggaaagcacctctttcattttttagtgtgagctaattccatcagactgctgtcctcctggacccatctgagatgtgcagtagcaaggagaggggggatcattttagagagtgggtcattggcagggagtgctccggagggaggcagaggggagactgtggtagaaggaagacagaactcacacatgctcccaggattggggacagggacagaggaggtaacagaaggcaaaggccagtttccccgttatcatgaaggggcccactcaggacaggaacaaggacaactcctcctcctcctcctcctctcctgctgctcctgggataccaggtcagtgatgtagtcttgcagtttggcaacttcctagcctgagaatccctagtggggctgtgggaaacacatttccacgttgcaagcatgcaactccaaagaatctgtgatgccactgaaatgagatgggaatgatccagctctttcagcatcttggttgaacttgctttcattgtccctgggatattgtggaaggaaaggtgactgtgtgatctgattctgtggtcaaggacttgcatcttgtgtttctatccccaagccttcctggtgtctccaactcctaccccattgcatgggttgttgcggacatccaataaagatttttttagtgcttctggaaacttccagtagattctacttctaaactatctctggagtccatccacttctgtctgcacccacagccatcctggccaggccacatcacctcccccagatcactgccctggcctcagaaaggtcttccctcttgctttgtcaatcagttctcagtagcagcagagagaaattgaaagctgcaggtcatatcgtatcatctttagtttgaaaacctcactctcttaccctattgttctaaaggtcttcttttggtcccaacctcatttccagcctcatttcttgccagtcccagacttgctccctgagcttctgccacctgcccttccttcatttcctcgacattccagccttgttcccacctccagcactttgcatatgctgttccctttgccaagaatgctcttcccctaccctgtgcatggctgagttctgcagaccctcaggccttggcttcaacgttgcctcgtccaagaggccttcctcgactactttacttgtggagttcctctatcacaaggcctctgttctttcccttcatggagaatttgccactgcatatccatttgtgtaatttacttgttggttgactgtgcctcccactcgagtgtaagctcatgaggccaggtgccatgcctggttcagtctccactctgtacccagcattgagcacagggcctggtccatagttggcgttcaataaatacttgttgaagaagtgaactgaaaaaaaaaaaaaaaaaa

SEQ ID NO: 375 - DNA, 1772 bp, Homo sapiens
ggataaatgtagcgccgcggcgcgggccagcagctctgcgaggggccggagcgcggcggagccatgcagtacccgcaccccgggccggcggcgggcgccgtgggggtgccgctgtacgcgcccacgccgctgctgcaacccgcacacccgacgcccttttacatcgaggacatcctgggccgcgggcccgccgcgcccacgcccgcccccacgctgccgtcccccaactcctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaaatagtttatgtactgctcttaggttgttttgataaagtgacattatagtgattaaattcttccccctttaaaaaaacagttagtggttttcactatttataaaaaattaattttgaactttttgttaaatttttaagttatagctttaaaggttttaataggaccttcttgaacgacttttctgtaatctgtttatctcccacttaatggaaaggcaaaggggtaccccaaatccagaggtgcctacatttcaggcagccttggagtattttaaaaggaaaacattctttacttttatatgacattcttatactgctgtctcaaatccaaaaacatttcagagctcttgtctcagagatgtgtgttctttttgtcagagatatggttgatgagaatcttaaatgcttgttttgcactatcacttagtacctgtttgaccaaggtgttaaggggatagtacctcccaattcaagcagagaaactgacctgactaaagttaatcgcagatgaactagaagtcacaggttaattaaatgtaagtagattgtagatactgttttatatcaaacaatgtttataatgtgtatatagaattgttcactgtaaaaaaaatggccaaaatgtgttttttttttaataagtaacttgactataaaataaagccgtccgtgggacgactgacctcgttgcaaaaaaaaaaaaaaa

SEQ ID NO: 376 - DNA, 8891 bp, Homo sapiens
gcggccgccgccatcagcagcgcagctccagggccggctgcagcggcagcggctccgccgggcgtcctggcagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaactgcgtagatggagatccgaaggcgctgatcctgccaaattcagtgacctcgatgaacaatgtgactcaagttccttgtcaagtaaaaccaggactgacaatagcgaatgcatctcttctcattgtggcactacgtccccctcctatacaaacactgcattcgatgtcttactgaaagcaatggagccagaactgagcaccttgtcacaaaagggctcaccttgtgcaattaagacagaaaaactgaggccaaataaaactgcacgttcccctcccaaattaaaaaacagttcaatggatgccccaaatcagacttcacaggaattggttgctgaatcacagtcttcttgtacctcatacacagtccatatgtctgctgctcagaagaatgagcaaggggcaatgcagtcagcttctcatttgtatcatcaacatgaacactttgttcccaaatccaaccaacataatcaacagcttccggggtgttcaggtttcacaggatcactgacaaatctgcaaaatcaagagaatgccaaacttgaacaggtttataatatagcagtgacatcatctgtaggcctaacttcaccttccagtagatctcaggttactcctcaaaaccagcaaatggattctgcttcacctttgtcaataagtccggctaattctacacagtcgccccccatgccaatctataattcaactcatgttgcctctgttgttaatcaaagcgtagagcaaatgtgcaatcttcttctgaaagatcagaagccaaaaaaacaaggaaaatatatttgtgagtattgcaatagagcatgtgcaaagcctagtgtgcttttaaagcatatccgctcccacactggagagcgaccctatccctgtgtgacttgtggattttcatttaagactaaaagtaatctgtataagcacaagaaatcccacgcacatactatcaaactgggtcttgtcttgcaaccagatgctggtggcttgttcttgtcccacgagtcccccaaagcacttagtattcattcagacgtagaagacagtggggagagcgaggaggaaggcgccactgatgagagacagcatgacctgggcgccatggagctgcagcctgtgcacataataaagaggatgtcaaatgctgaaactttactaaaatcaagcttcactccaagcagtccagaaaatgtgataggtgactttttgctacaggacagatctgcagaatcacaagctgtgacagagttaccgaaagttgtggtccaccatgtcactgtgtcccccttaagaactgacagtccaaaggccatggatcccaagcctgaactttctagtgcacaaaagcagaaggaccttcaggtgacaaacgtacagccactttcagccaacatgtcccagggtggagtctccaggttggagactaatgagaattcccaccagaaaggcgacatgaatccactggaaggaaagcaagactctcacgtaggaacggtacacgcccagctacaaaggcagcaggctaccgattactcccaagagcagcaaggaaagctcctgagtcctcgaagtttaggaagtacggattctggttacttttcacgttctgaaagtgccgatcaaacagtgagtccaccaactccctttgccagaaggttacccagcacagaacaagactctggaaggagtaacggaccctctgcagctcttgtcaccacgtcaacaccctctgctttgcccacaggggaaaaggcattgcttttaccaggtcagatgcgcccacctttggccacaaaaacacttgaggagcggatatcgaagcttatctcagacaatgaagctttggtagatgacaagcaactggatagtgtgaagccgcggagaacctcactgtcaagacgaggaagcattgattcccccaaatcatacatatttaaagattctttccagtttgatttaaaaccagtgggacggagaacaagttcaagctctgatataccgaagtcacctttcacccctactgaaaaatcaaagcaagtgtttcttctgtctgtaccttcacttgactgtttacctatcacaagaagtaattccatgccgaccacaggttattcagcagtacctgcaaatataatacctcctcctcatccactaagaggaagtcagtcatttgatgacaaaattggcactttctatgatgatgtctttgtatcgggacctaacgctcctgtgccccagagtgggcatccccgtacacttgtgagacaagcagccatagaagactcttcagcaaatgaaagtcatgttcttggtactggacagtccctggatgagagccaccaaggatgccatgctgctggtgaagccatgtcagtgaggagcaaggcactggcacaaggcccacatatagaaaaaaagaagtctcatcaagggcgagggacaatgtttgagtgtgaaacttgtagaaacaggtataggaaactggaaaattttgaaaatcataagaaattttactgttctgagttacatggaccaaaaacaaaggtagccatgagagaacctgagcacagccctgtgcccggcggtctgcagcctcagattctacactacagagtcgctgggtcctccggcatctgggaacagacgccccagataagaaaaaggaggaaaatgaaaagtgttggggatgatgaagaacttcagcaaaatgaaagtggaacatctccaaaaagttctgaaggccttcagtttcagaatgctctgggctgtaatcccagtttgcctaaacataatgttaccataagaagtgaccagcagcataaaaatatacagttgcaaaactcccatattcaccttgttgccaggggccctgagcagaccatggatcccaagctgtcgaccatcatggaacaacagataagttcagcagcccaggacaagatagaactgcagagacacggaactggaatctctgtcatccagcacaccaactccctgagcaggcccaactcatttgacaagcctgagccttttgaaagagcctccccagtttctttccaggagctgaatagaacggggaagtccgggtctctaaaagtgataggaatctcccaagaggaaagtcacccttctcgggacgggtctcatcctcaccagcttgcactatcagacgctctcagaggagaacttcaggaaagctccagaaagagtccaagtgaacgacatgtgttaggacagccctcaagacttgtccggcagcacaacatccaagttccagagattttggtcacagaagaaccagatcgagacctggaagctcaatgccatgatcaagaaaagtcagagaagttcagttggccccagcgtagtgaaaccttgtcaaaattgccaacagagaaactgccacccaaaaagaaaaggctccgtctggctgagatagaacattcctcaacagaatcgagctttgattccactctctccaggagtctaagtagggagagcagtttatctcacacttcaagtttctcagcctctttagacatagaggacgtttctaaaacggaggcttcccccaaaatcgattttctaaataaagccgagtttcttatgattccagctggcttgaatactctgaatgttcctggatgtcaccgggaaatgaggcgtactgcatcagaacagattaattgcacgcaaacgtcaatggaggtctctgatctcagaagcaaatcattcgattgtggaagcatcaccccaccccagacaacaccacttactgaattgcagcctccatcttcaccttctcgagtgggagtgactgggcatgtgcctctcttagaaagaaggagaggcccactggtacggcaaatatctttaaacatagccccagatagtcatctgtctcctgtacacccaacatctttccaaaatactgctcttcccagtgtgaatgcagtgccatatcaggggcctcagctcactagtacatctttagctgagttttctgcaaatactttgcactctcagactcaggttaaggatctgcaggcagaaacatcaaactccagctctaccaacgtttttcctgttcaacagctctgtgatatcaatttgttaaatcaaatccatgcaccgcctagccaccagagcacacagctatctctgcaagtgtctacgcagggtagcaagccagataaaaattctgttttatctgggtcttctaaaagtgaggattgctttgctcccaaataccaattgcattgtcaggttttcacttcaggcccatcttgctcttctaatcctgtgcattctttgccaaatcaagttatttcagatccagttggaacagatcattgtgtgacatcagcaacattaccaaccaaattaattgacagcatgtctaattcgcatcctctgctaccaccagagctcaggccccttggaagtcaggtgcagaaggtgccatcatcattcatgctgcccatacgcctgcagagtagtgttcctgcttactgttttgctacactcacatccctgccacaaatactagtgacccaagatctgcccaatcagccaatttgccagactaatcatagtgtagtgccaatcagtgaagaacaaaattctgtgccaacattacaaaaaggtcatcagaatgctttgccaaacccagagaaggaatttctatgtgaaaatgttttttcagagatgagccaaaattcttctctatcagaatccttgcccataactcagaaaatatctgttggtcgactttcccctcaacaagaatcttcagcttcgagtaaaaggatgctttccccagcaaatagtttagacattgccatggaaaagcaccagaagcgggccaaagatgaaaatggagctgtttgtgcaacagacgtgagacctttagaggctttgagttcgagagttaatgaagctagtaaacagaagaagcctattttagtgagacaggtttgtactacagagcccctggacggtgtgatgttggaaaaggatgttttttctcaacctgaaattagtaatgaggctgttaatttgacaaatgttttaccagctgataattcatcaacaggatgctctaaatttgtcgttatagaacctataagtgaattgcaggaatttgaaaacatcaagtcatccacatcattaactcttacagttcgaagttcacctgctccttcagaaaatactcatatttctcctttgaaatgtacagacaataaccaagaaaggaagtctccaggggttaaaaatcaaggtgacaaagtgaacatccaagagcaaagtcaacagccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaagagagcattaggtaatcaaaagtccacagtagttgaattcagcaataaagatgcctctgaaattaacagtgagcaagataaagaaaattccttaatcaaaagtgaaccaagaagaattaaaatatttgatggaggatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaaggaaatctgacaaaacacatgaagtccaaggcacatagcaagaaatgtgtggatttaggcgtctcagtaggtttaatagatgaacaggatacagaagaatcagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgactttaaaaaaaaaaaaaaaaaa

SEQ ID NO: 377 - DNA, 9732 bp, Homo sapiens
gctggaggcaggaatgtgcctgcttactaatgagcgacgtgcaccggcgcgcacggcccggccaccgctgcggctgcggcggccggcggcggcccgttgtcaggtggagcctttgaattttttaaaagaccatagtaatcagatctacttgaaaaattaagtgaattgatttggttggaatgctcttttaccgatgctttaacatacagccactagattcccagaagttgtgcatgagttcctgtgaggagagttggcatcttggaaatcaaagacggttgtgatgcagttttttgatatgaggataacaggaagcgtcaggacaatcatgcccataagaactctaaactgttcagatcattttatcttagtgaaactggcaattgaactttgctctagttgatgggcaaaatttctcctagactattcatcatcccaatttcatcctagttgaaaattttcaaatgccataagaaatctttatagatttgcacttagcttttggatggacgtttctacaatggagagaactgtgttatagccctggtccaaggacattactagctaatgcccatcgactgtggtgtgcgtgtggaaggttccaaagagaaggagcaatcagcaagtttgcagacaccctggaacatggaagcaaccaagctttaagaagcacagctttggagacactccatgagtctgcactgctttcaggggaactagcacttaagaccttgtgtaacaaaatggacactggggacacagctctaggacaaaaagctacctcaaggtctggagaaactgataaagcatcaggtagatggagacaggaacaatcagctgttattaagatgagcacttttggcagtcatgaaggacagcggcaaccacaaatagagcctgagcaaatcggaaacacagcatcagcacaactgtttggttctgggaaactggcctcccctagtgaagtggtgcagcaagtcgcagagaagcaatatccaccgcatcgtccgagtccttactcatgccaacactcactctctttccctcagcactcattgccacagggggtcatgcacagcaccaagccacatcagagcctcgaaggtcctccgtggcttttccctggccctttgccatccgttgcctctgaggacttatttccttttcctatacatggccacagtggtggttatcctagaaaaaagatttcaagtctgaaccctgcttatagccaatactcccagaaaagtattgaacaggcagaagaggctcacaagaaagagcacaaacccaaaaagcctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcctgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtacaaatcgaatgaagattatgtatatgtcagaggacgtggccggggaaagtacatttgtgaagaatgtgggattcgctgtaagaagccaagcatgctcaaaaaacacatccgtacccatactgatgttcggccttatgtatgcaagttatgtaactttgccttcaaaacgaaaggaaacctaacgaagcatatgaaatctaaagcacacatgaaaaaatgcctggaattgggagtctcaatgacatcggtggatgatacagaaactgaggaagcagaaaatttggaagatttgcacaaagcagcagagaagcatagcatgtccagcatttcaactgatcatcagttctccgatgctgaggaatcagatggtgaggatggagatgataatgatgatgatgatgaagatgaagatgactttgacgaccagggagatttaacaccaaaaacaagatcaagaagcaccagtcctcagcctcctagattctcctccttgcctgtgaatgttggcgccgtaccccacggggttccttcagatagttccctgggacattcttcgttgatcagctatttggttactttgccaagtattcgagttactcagcttatgacacccagtgattcatgtgaagatacccagatgacagaataccagaggctattccagagcaaaagtacggactcagaaccagacaaagacagattggacatacctagttgtatggatgaggagtgcatgctaccttcagagccaagctcctctcccagggacttctcaccctcaagccaccattcctctccaggatatgattcttcaccctgtcgagataattcaccaaagaggtatctgatacccaaaggagatttatctcccaggagacatttatcacctaggagagatctgtcacccatgagacatctttcaccaagaaaggaagctgcattgagaagagagatgtcccaaagagatgtttcaccaagaaggcatttgtctccaaggaggccagtgtctcctgggaaagatatcacagcaagaagagacctctctcctagaagagagagaagatacatgaccacaataagagcgccatctcccagaagggctttataccataacccaccattgtccatgggacagtatttgcaagcagagccaattgtattggggcctcctaatttaagaagaggattacctcaggttccttacttcagtctctatggagaccaagaaggtgcttatgaacatccaggctccagccttttccctgagggtcctaatgactatgtcttcagtcatcttccactccactctcagcaacaagtgcgagcccctatccccatggtgcccgttggtgggatccagatggttcactccatgccgccagccctttccagtttacatccttcacccacattgcccctgccaatggagggctttgaggagaagaaaggcgcgtcaggggagtccttctccaaggacccctatgtgctttctaagcagcatgagaagcgaggtcctcacgctttgcagtcatctggtccacctagcactccctcctctcctcggctgttgatgaaacagagcacttcggaagacagcctaaacgcaacagagcgggaacaggaggaaaatatacagacttgtacaaaagccattgcctctctccggattgccacggaagaggcagctctgctcgggccagatcagccagcgcgggtgcaggagccccaccagaaccccctgggaagtgcacatgttagcattagacactttagtagacctgagccaggtcagccctgtacctcagccacccaccctgacttgcatgatggtgaaaaggacaattttggtacatcacagactccattagctcactccacgttttacagcaagagttgtgtggatgacaagcagttggactttcacagcagcaaggaattatcttcaagcacagaggaaagcaaagatccttcatcagaaaagagtcagctacattgatctatgatgcatggagactttcatttccacattttcccatttttttgtttttgtttttctagaaatggaggtaatccagtttatagcatgcctgtcctaagttacagtagtttgctattatatatacttttgttatatcaaaagaattaggtaaattaacaagtcatcatgagcctgaccaaaacaaaatttgaaattaacctattgggtctggtacttttaaaattgtacagatgtttgtgccttttctttactttgcttatattcttataagcattttttagcagtaatttgtacatattttagaatttgtgtatctgctttgtaataaatgtaatttctttccttttttggacacttggatctaaatgatgtaaagcaaaacagcatcaatatatatgtgaggttgcactaaaacatatttttatatgattaaaactgaacagcttttatgtacagctctgattctgtaatactaatatttatttactttgtttcataaattgtacattttttcttaatgttgtggattgcttttctatgtgaagcatgggatttactgttgcgtaactagaacaaaaatgtacattgtaaacaagatatttaaactagagtatcttattctgcacttatgcattagttaaaaaaagataaaggatgtatcagtcagttcttaactcttgtatatttttttgtctcttgtttgctggattgactataacttaagtgctgattgtgattttaaaatgatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaacattccaccccatgtaaatatgtacaagtgcatcactggtacaattttatgtaactcagttggacactaggttgccacagacctatgctaggtgtctttaaaaaattaaggtgacaaagcacatgggactgtgtagagcttggttatcggccggcccggtggcttggcaggcagtgctgtgcgctgctcatggagaagacctgggcttagcaatctccttagttcttgctacacaggatggtgactggaactaaggctacacagagggtcgcacttggactctgagggttgggtgtggaagggggaaaaggagatggagacctgctccccagctcttcctgtcagccggtttacatgggaacagggttaacatctgtgttaggggaggtcaccttaccctttttcataggggaagagtgtcacactcctggctatctcagggggaatggggaaaagaatctttcaagggcaaagaactcgtgggaggatgtctgttgtatgtaatactcacaatggcttttggttagtgttgaaggtgggaagagcatttgtaggtccagaagagtgaaagagagggaggggtgcagcaacatgtgcacaggcacgcacatgtgtgcacgcacacatacaatctgggttatctttgtgctatatagtggattataattctgtgaaaccaagtttgtatattgaattacattaaggagtgttctttaaaaagagaaataaatatacaattacatgcttgaaaaaaaaa

SEQ ID NO: 378 - DNA, 8875 bp, Homo sapiens
attccgtgtttttcagcagcacgaattcaagagggatgcttctgtttgggtttctgatcgtgatttatatttattcagaggaataacagagggtggatctgttcccggcgcgagcatgctcacaaccagccgactctcccattatccagctgcctagtttggtgcttcaatgtacatggctattccgtgtgcatatgtgtgtatacaaacacgcatgcatgcctggatggacatacgtatgcacaggttattttttaaggacaattctttcaataaggtctttaccccttacttgaaacaggtgttcatgaaaaaaatgcacaaaatcctgcctggccggaataattcatgaagaaggggctggatccgtgggtcagagaacacaggaccagtttgccatcccaaggccgaaggcctccctccaacacagttctccaagctctagaaatctctgacacatcttgaccatgagaccacggctggtttttggcaggattcgaggcacaaacccagcagcctcaacctagttcatggaggagcctcgcggggtcctggccaagcaagcccgcccctctggtgggaagagcggcgcctaggtggagggtggctgccgtaggagtggacatgaatgctggctttcagagagaacagcgtttcagttttggtcatcggaagtggtgccttcagcacagaagaagagcgtgatttctcctccaaggccgttgatctccaacccagaactaaaggggagaagagccacccccagcatccagcgtggcatctcttgtgccaggaccagggatgactgggccatggacacagatgtctccaaccttcaaccgtttgcatagcacacgggggactcgtgggggccacctgccactgccagctgaaacaatacaatggcaatactgacatccttcatgacgttttcccgacagacattcaggcagaaagtgctggtgcgttttctgtctgcaaagtagagggccatgcctcaccaatagaatagcgtgggccctgatgacctgctccgagtccactcacagccagtgacacttgcaaaaaactcccaaagccgtcttgggtttggctcccacagctcttgaccaatgtggccaaagctggacacctccttgggacactgggattattcataaatgcagcccgccctgactctccctgaatagcatctgaagtctttgtgaaggtcatggatcctgaacaaagtgtcaagggcaccaagaaggctgagggaagtccccggaagcggctgaccaaaggagaggccattcagaccagtgtttcttccagcgtcccatacccaggcagcggcacagctgccacccaagagagccccgcccaagagctcttagccccgcagcccttcccgggcccctcatcagttcttagggaaggctctcaggagaaaacgggccagcagcagaagccccccaaaaggccccccatcgaagcatccgtccacatctcacagcttccgcagcaccctctgacaccagcattcatgtcgcctggcaaacctgagcatctcctggaggggtccacatggcaactggttgaccccatgagacctggaccctctggctccttcgtggcccctgggctccatcctcagagccagctccttccttcccacgcttccatcattccccccgaggaccttcctggagtccccaaagtcttcgtgcctcgtccttcccaggtctccttgaagcccacagaagaggcacacaagaaggagaggaagccccagaagccaggcaagtacatctgccagtactgcagccggccctgtgccaagcccagcgtgctccagaagcacattcgctcacacacaggtgagaggccctacccctgcggcccctgtggcttctccttcaagaccaagagtaatctctacaagcacaggaagtcccatgcccaccgcatcaaagcaggcctggcctcaggcatgggtggcgagatgtacccacatgggctggagatggagcggatccctggggaagagtttgaggagcccactgagggagaaagcacagattctgaagaggagactagtgccacctctggtcaccctgcagagctctccccaagacccaagcagccccttctctccagcgggctatacagctctgggagccacagttccagccacgaacgctgttccctgtcccagtccagcacagcccagtcactcgaagacccccctccatttgtggaaccctcatctgagcaccccctgagccataaacctgaagacacccacacgattaagcagaagctggccctccgcttaagcgagaggaagaaggtgatcgatgagcaggcgtttctgagcccaggcagcaaagggagtactgagtctgggtatttctctcgctccgagagtgcagagcagcaggtcagccccccaaacaccaacgccaagtcctacgctgagatcatctttggcaagtgtgggcgaataggacagcggaccgccatgctgacagccacctccacccagcccctcctgcccctgtccaccgaagacaagcccagcctggtgcctttgtctgtaccccggacgcaggtgatcgagcacatcacgaagctcatcaccatcaacgaggccgtggtggacaccagcgagatcgacagcgtgaagccaaggcggagctcactgtccaggcgcagcagcatggagtccccaaaatccagcctctaccgggagcccctgtcatcccacagtgagaaaaccaagcctgaacaatcactgctgagcctccagcacccgcccagtaccgccccccctgtgcctctcctgagaagccactcaatgccttctgccgcctgcactatcagcaccccccaccaccccttccgaggtagctactccttcgatgaccatatcaccgactccgaagccctgagccacagcagtcacgtgtttacctcccacccccggatgctgaagcgccagccggcaatcgaattacctttgggaggggaatacagttctgaggagcctggcccaagcagcaaagacacagcctccaagccctcggacgaagtggaacccaaggaaagcgagcttaccaaaaagaccaagaagggtttgaaaacaaaaggggtgatctacgaatgtaacatatgtggtgctcggtacaagaaaagggataactacgaagcccacaaaaaatactactgctcagagcttcagatcgcaaagcccatctctgcaggcacccacacatctccagaagctgaaaagagtcagattgagcatgagccgtggtcccaaatgatgcattacaaactgggaaccaccctggaactcactccactgaggaagaggaggaaagagaagagccttggggacgaggaagagccacctgcctttgagtccacaaaaagtcagtttggcagccccgggccatctgatgctgctcggaaccttcccctggagtccaccaagtcaccagcagaaccaagtaaatcagtgccctccttggagggacccacgggcttccagccaaggactcccaagccagggtccggttcagaatcagggaaggagaggagaacaacgtccaaagaaatttctgtcatccagcacaccagctcctttgagaaatctgattctctcgagcagccgagtggcttggaaggggaagacaaacctctggcccagttcccatcacccccacctgccccacacggacgctctgctcactccctgcagcctaagttggtccgccagcccaacattcaggttcctgagatcctagtaactgaggagcctgaccggccggacacagagccagagccgccccctaaggaacctgagaagactgaggagttccaatggccccagcgcagccagacacttgcccagctcccagctgagaagctgccacccaaaaagaagaggttgcgcctggcagagatggcccaatcatcaggggagtccagcttcgagtcctctgtgcctctgtctcgcagcccgagccaggaaagcaatgtctctttgagtgggtccagccgctcagcctcgtttgagagggatgaccatgggaaagccgaggcccccagtccctcatctgacatgcgccccaaacccctgggcacccacatgttgactgtccccagccaccacccacatgcccgagagatgcggaggtcagcctcagagcagagccccaacgtttcccattctgcccacatgaccgagacacgcagcaaatcctttgactatggcagcttgtccttgacaggcccttctgctccagccccagtggctccaccagcgcgggtggccccgccagagagaagaaaatgcttcttggtgagacaggcctctctgagcaggcctccagaatctgagttggaggttgcccccaagggaagacaggagagcgaagaaccacagccctcatccagtaaaccctctgccaaaagctcattgtcccagatttcctctgcggccacctcacatggtggacccccgggaggcaagggcccagggcaggacaggcccccattggggcccactgtgccctacacagaagcactgcaagtgttccaccaccccgttgcccagacacccctgcatgagaagccatacctgcccccaccagtctcccttttctccttccagcatctcgtgcagcatgagccaggacagtctccagaattcttctccacccaggccatgtccagcctcctgtcctcaccatactccatgcccccacttcctccctccttatttcaagccccaccgcttcctctccagcctactgttctgcacccaggccaactccatctcccccagctcatgcctcacccagccaacatccccttcaggcagcccccttccttcctccccatgccatacccgacctcctcagcactgtcttctgggtttttcctgcctctgcaatcccagtttgcacttcagctccctggtgatgtggaaagccatctgccccagatcaaaaccagcctggccccactggcaacaggaagtgctggcctctcccccagcacagagtacagcagtgacatccggctaccccctgtggctcccccagccagctcctcagcacctacatcagctcctccactggccctgcctgcctgtccagacaccatggtgtccctggttgtgcctgtccgtgttcagaccaatatgccgtcctatgggagcgcaatgtacaccaccctttcccagatcttggtcacccagtcccaaggcagctcagcaactgtggcacttcccaagtttgaggaacccccatcaaaggggacgactgtatgtggtgcagatgtgcatgaggttgggcccggcccttctgggttaagtgaagagcaaagcagagctttcccaactccatacctgagagtgcctgtgacattacctgaaagaaaaggcacttccctgtcatcagagagtatcttgagcctggaggggagttcatcaacagcagggggaagcaaacgtgtcctttcaccagctggcagccttgaacttaccatggaaacccagcagcaaaaaagagtgaaggaggaggaggcttccaaggcagatgaaaaacttgagctggtaaaaccatgcagtgtggtccttaccagcaccgaggatgggaagaggccagagaaatcccacttaggcaaccagggccaaggcaggagggagctagaaatgctgtccagcctgtcctcagatccatctgacacaaaggaaattcctcccctccctcaccctgcattgtcccatgggacagccccaggctcagaagctttgaaggaatatccccagccatctggcaaacctcaccgaagagggttgaccccactgagcgtgaagaaagaagattccaaggaacaacctgatctcccctccttggcacctccgagctctctgcctctgtcagaaacgtcctccagaccagccaagtcacaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccgggggtttccactaaagctgctttgtccctcctgaggtctaagcagaaagtgagcaaagagacatacaccatggccacagctccgcatcctgaggcaggaaggcttgtgccatccagctcccgcaagccccgcatgacagaggttcacctcccttcactggtttccccggaaggccagaaagatctagctagagtggagaaggaagaagagaggagaggggagccggaggaggatgctcctgcctcccagagaggggagccggcgaggatcaaaatcttcgaaggagggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaagggaatctgactaagcacatgaagtcgaaggcccacagcaaaaagtgccaagagacaggggtgctggaggagctggaagccgaagaaggaaccagtgacgacctgttccaggactcggaaggacgagagggttcagaggctgtggaggagcaccagttttcggacctggaggactcggactcagactcagacctggacgaagacgaggatgaggatgaggaggagagccaggatgagctgtccagaccatcctcagaggcgcccccgcctggcccaccacatgcactgcgggcagactcctcacccatcctgggccctcagcccccagatgcccccgcctctggcacggaggctacacgaggcagctcggtctcggaagctgagcgcctgacagccagcagctgctccatgtccagccagagcatgccgggcctcccctggctgggaccggcccctctgggctctgtggagaaagacacaggctcagccttgagctacaagcctgtgtccccaagaagaccgtggtccccaagcaaagaagcaggcagccgtccaccactagcccgcaaacactcgctaaccaaaaacgactcatctccccagcgatgctccccggcccgagaaccacaggcctcagccccaagcccacctggcctgcacgtggacccaggaaggggcatgggcgctctcccttgtgggtctccaagacttcagctgtctcctctcaccctctgccccctgggaagagaactggcccctcgagcacatgtgctctccaaactcgagggtaccaccgacccaggcctccccagatactcgcccaccaggagatggtctccaggtcaggccgagtcaccaccacggtcagcgccgccagggaagtgggccttggctgggccgggcagcccctcagcgggggagcatggcccaggcttggggctggacccacgggttctcttcccgcccgcgcctctacctcacaagctcctcagcagaagcccagagacctgcgcctccccgtggcagaaggccgagtcccgaagtccctcctgctcacccggccctgctcatcctctctcctcccgacccttctccgccctccatgacttccacggccacatcctggcccggacagaggagaacatcttcagccacctgcctctgcactcccagcacttgacccgtgccccatgtcccttgattcccatcggtgggatccagatggtgcaggcccggccaggagcccaccccaccctgctgccagggcccaccgcagcctgggtcagtggcttctccgggggtggcagcgacctgacaggggcccgggaggcccaggagcgaggccgctggagtcccactgagagctcgtcagcctccgtgtcgcctgtggctaaggtctccaaattcacactctcctcagagctggagggcggggactaccccaaggagagggagaggaccggcggaggcccgggcaggcctcctgactggacaccccatgggaccggggcacctgcagagcccacacccacgcacagcccctgcaccccacccgacaccttgccccggccgccccagggacgccgggcagcgcagtcctggagcccccgcttggagtccccgcgtgcaccgaccaaccccgagccttctgccaccccgccgctggaccgcagcagctctgtgggctgcctggcagaggcctctgcccgcttcccagcccggacgaggaacctctccggggaacccaggaccaggcaggactcccccaagccctcaggaagtggggagcccagggcacatccacatcagcctgaggacagggttccccccaacgcttagcctctctccaactgcttcagcatctggcttccagtgtccagcaacagacgtttccagccactttcctcgaatcatcccacttcctcagccccatctgtccctccgtccaggagctctcacggccccatctgttgtaccttcccatgtatgcagttacctgtgcctttttctacaccttttgttgcttaaaaagaaacaaaacaaatcacatacatacatttaaaaaaaaaacaacaacccacgaggagtctgaggctgtgaatagtttatggttttggggaaaggctgatggtgaagcctcctgaccctccccgctgtggttggcagccacccaccccagaggctggcagagggaaaggggtacactgagggagaaaggaaaaggaaacttcaaacaatatagaattaaatgtaaaaggaagcactcctgtgtacagaaaa

SEQ ID NO: 379 - DNA, 1989 bp, Homo sapiens
tagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgatcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtgaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcaaaaaaaaaaaaaaaaaaaaaaaaaaaaaaaaaaaaaaaaaaaaaaaa

SEQ ID NO: 380 - DNA, 320 bp, Homo sapiens
cccaacaaaaggagaccctgtacgtgcgaagagtgtggcaaggcctttggacagagaagtcaccttgttcagcacaccagtgagaagctgtatgcatgccaggaatgtgggtgtaccttcagcaacaattcatctctagtcaagcactggcacgtccacacaggcgagaagccctacatgtgtggccactgtggcaagtgcttccgagagagctcatcccttgccaagcaccagcgtgtgcacacaggtgagaagccatacgtgtgtggtgagtgtggacgcaccttcagcgagagcacacaccttgtacagcactggtg

SEQ ID NO: 381 - DNA, 2412 bp, Homo sapiens
cgtcacgtccggcgcggagacggtggagtctccgcactgtcggcggggtacgcatagccgggcactaggttcgtgggctgtggaggcgacggagcagggggccagtggggccagctcagggaggacctgcctgggagctttctcttgcataccctcgcttaggctggccggggtgtcacttctgcctccctgccctccagaccatggacggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgagtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatgccccacatgtcataaaaagttcctcagcaaatattatctaaaagtccacaacaggaaacatactggggagaaaccctttgagtgtcccaaatgtgggaagtgttactttcggaaggagaacctcctggagcatgaagcccggaattgcatgaaccgctcggaacaggtcttcacgtgctctgtgtgccaggagacattccgccgaaggatggagctgcgggtgcacatggtgtctcacacaggggagatgccctacaagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaagccgtggagcaactgcgtgtgcacgtcagacggcacaagggggtgaggaagtttgagtgcaccgagtgtggctacaagtttacccgacaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttggactctcgtaaaaaaaaaaaaaaaaaaaaaaaaaaaaaaaaaaaaaaaaaaaaaaaaaaaaaaaaaaaaaaaaaaaaaaaaaaa

SEQ ID NO: 382 - DNA, 5607 bp, Homo sapiens
actcttgtcagggccgcggcacatgggcggccggatgcgctgagcccggcgctgcggggccgcggagcgctggggagcagcggccgccggcgcggggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacgcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaatgtattctcttgtgtgccaggagaggtttcagaaacctacctcgtcttacaaatttaaacactttggagtctgtacaggtgccttatatgtaggtcattgtcacgatacacacacacgaacactccctctggactggctgcctctccatccagggcagttaactagcaaacaaggcagatctgcttcatggagcgggaggccatggcttgactctgagtgatttgggtcaaccggagtcagacgcatgtctgcacgctgcagctattatgagagtccctttgtcatttttcaccttttcatcctaagcatctttcagagattaattatttggccattaacaatgaatccaaatcatatcatactgacatcatctagacatgatttggaaggaacagcttaggacctcctgatgaggtcacattgttgtttcttttaactagacttggcaaagaaaggcaaaaattgaccagcctatctttctgctggtgctgccttaaggaggtagtttgttgaggggagggctgtagatcattacttctttctcttcaggaagtggccactttgaaccattcaaataccacattaggcaagactgtgataggccttttgtcttcaaatacaacaggcctccactgacccatccctcaaagcagaaggaccctttgaggagagtacagatgggattccacagtggggtgggtggaatggaaacctgtactagaccacccagaggttccttctaacccactggtttggtggggaactcacagtaattccaaatgtacaatcagatgtctagggtctgttttcggaagaagcaagaattatcagtggcaccctccccactgcccccagtgtaaaacaatagacattctgtgaaatgcaaagctattctttggtttttctagtagtttatctcattttaccctattcttcctttaaggaaaactcaatctttatcacagtcaattagagcgatcccaaggcatgggaccaggcctgcttgcctatgtgtgatggcaattggagatctggatttagcactggggtctcagcaccctgcaggtgtctgagactaagtgatctgccctccaggtggcgatcaccttctgctcctaggtacccccactggcaaggccaaggtctcctccacgttttttctgcaattaataatgtcatttaaaaaatgagcaaagccttatccgaatcggatatagcaactaaagtcaatacattttgcaggaggctaagtgtaagagtgtgtgtgtgtgtgtgtgcgtgcatgtgtgtgtgtgtgtatgtgtgtgaataagtcgacataaagtctttaattttgagcaccttaccaaacataacaataatccattatccttttggcaacaccacaaagatcgcatctgttaaacaggtacaagttgacatgaggttagtttaattgtacaccatgatattggtggtatttatgctgttaagtccaaacctttatctgtctgttattcttaatgttgaataaactttgaattttttcctttcaaaaaaaa

SEQ ID NO: 383 - DNA, 2308 bp, Homo sapiens
aaaactttgggagtttttagagacgagtttttttttttttctattacttttccccccccctaactaacggactattattgttgttgttttaaatttagctcttagggcttagctatttgggttttcttgcggtgtccggctcccgtctccctggctcccccgcccgccctgcggccccagcgcccctcgctctcatccagcccgcgaggagtgcgggcgccgcgccgcctttaaagcgaggccagggagcgaggcggtgaccggccgagatccggccctcgcctcctccctcggtggcgctagggctcccggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatgttcgcagccgggctggctcccttctacgcctccaacttcagcctctggtcggccgcttactgctcctcggccggcccaggcggctgctccttccccttggaccccgccgccgtcaaaaagccctccttctgcatcgcagacattctgcacgccggcgtgggggatctgggggcggccccggagggcctggcaggggcctcggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacagcctccgcctccgccccgggctggcgccctgcagcccccggcctcggggacgcgagtggttccgaacccccaccacagtggctctgccccggccccctccagcaaagacctcaaatttggaattgaccgcattttatctgcagaatttgacccaaaagtcaaagaaggcaacacgctgagagatctcacttccctgctaaccggtgggcggcccgccggggtgcacctctcaggcctgcagccctcggccggccagttcttcgcatctctagatcccattaacgaggcttctgcaatcctgagtcccttaaactcgaacccaagaaattcagttcagcatcagttccaagacacgtttccaggtccctatgctgtgctcacgaaggacaccatgccgcagacgtacaaaaggaagcgttcatggtcgcgcgctgtgttctccaacctgcagaggaaaggcctggagaaaaggtttgagattcagaagtacgtgaccaagccggaccgaaagcagctggcggcgatgctgggcctcacggacgcacaggtgaaggtgtggttccagaaccggcggatgaagtggcggcactccaaggaggcccaggcccaaaaggacaaggacaaggaggctggcgagaagccatcaggtggagccccggctgcggatggcgagcaggacgagaggagccccagccgttctgaaggcgaggctgagagcgagagcagcgactccgagtccctggacatggcccccagcgacacggagcggactgaggggagtgagcgttctctgcaccaaacaacagttattaaggccccggtcactggcgccctcattaccgccagcagtgctgggagtggtgggagcagcggcggcggcggcaatagtttcagcttcagcagcgccagcagtcttagtagcagcagcaccagtgcgggttgcgccagcagccttggcggcggcggcgcctcggagcttctccctgcaacacagcccacagccagcagcgctcccaaaagccccgagccagcccaaggcgcgcttggctgcttatagactgtactagggcggaggggatccgggccttgcgtgcagcctcccaaccatgggctgggttttgtgcttactgtatgttggcgacttggtagggcaggagacgcagcgtggagcctacctcccgacattcacgcttcgccccacgctgctccgactggctgcagcggacactgcccaaagcagaggggagtctcagtgtcctgctagccagccgaacacttctctccggaagcaggctggttcgactgtgaggtgtttgactaaactgtttctctgactcgccccagaggtcgtggctcaaaggcacttaggacgccttaaatttgtaaataaaatgtttactacggtttgtaaaaaaaaaaaaaaaaaaaaaaaaaaaaaaaa

SEQ ID NO: 384 - DNA, 2176 bp, Homo sapiens
cagcggcctccgcgcggtcgcctgagggctgcagcgcaaagaaccgggctcccgggcccggacgcggggaagcactcgcgtgggagtttgtgcgagcgcggcccggggcggggcccgcacggaggaggcgccgggaccatggtcaccctcggctgagtttccggcggcgactttgattattggcaaataaccaccataacaataccgagcccccgggcttgcaccgcacgcactgactccgcgagcccgcacacggccgcgtcgcccgccaccgggccctgagcgccagccccaaacgagccgatggaaaaatccaaaaatttccgcatcgacgccctgctggcggtggaccccccacgagccgcctctgcgcagagcgcgccgctggccttggtcacgtcgctcgccgccgccgcatctggcaccggaggtggcggcggcggcggcggggcgagcggcgggactagcggcagctgcagccccgcgtcctcggagccgccggctgcgcccgccgaccgcctgcgcgccgagagcccgtcgccgccgcgcctgctggccgcgcactgcgcgctgctgcccaagccgggcttcctgggcgcgggcggcggcggcggcggcacgggcggcgggcacggggggccccaccaccacgcgcatccgggcgcagcggccgctgccgccgccgccgccgccgccgccgccgctgggggcctggcgctggggctgcaccctgggggcgcgcagggcggcgcgggcctcccggcgcaggcggcgctctacggccacccggtctacggctactccgcggcggcggcggcggctgcgctggcgggccagcacccggcgctctcctactcgtacccgcaggtgcaaggcgcgcaccccgcgcaccccgccgaccccatcaagctgggcgccggcaccttccagctggaccagtggctgcgcgcgtccaccgcgggcatgatcctgcctaagatgcccgacttcaactcccaggcgcagtcgaacctcctggggaagtgccgccggccgcgcaccgccttcaccagccagcagctgctggagctggagcaccagttcaagctcaacaagtacctgtcgcggcccaagcgcttcgaggtggccacctcgctcatgctcaccgagacccaggtgaagatttggttccagaaccggcggatgaaatggaaacgcagcaaaaaggccaaagagcaggcggcgcaggaagcggagaaacagaagggcggcggcgggggcgcggggaagggcggcgcggaggagccgggagccgaggagctgctggggccgccagcgcccggagacaagggcagcggacgccgcctgcgggacttgagggacagtgaccccgaggaggacgaggacgaggacgacgaggaccatttcccctacagcaacggcgccagcgtccacgccgcctcctccgactgctcctcggaggacgactcgccgcccccgcggcccagccaccagcccgcgccccagtaggagccccgcggcccagcaggtgcggcgcgcacggagcgccccggccggcggcttctcccggaggccccggcgcccgcacccacccggcccggccccgagagcaggctcgaccgccgccccatggacccctcgcccaggccggggctggagggattcggccgcggctccggtcctgggcgcttcccttttaagcaagggcgcctcacctgctcttcaagaaacagcgagagggagacccagggggctgaaacttgaactctggttcttttaaaattaattttggttggtgttgggggaggcgcgagtgcgtgtgagaagaaccgacccaccccgcgcaaggggaagcctcctgtctcccctttccccgcgtccgagaaggcggaaacccacagtgttacctgacttatgaaacttgaaaccgcctctggagccgccattctgcagagtatttggaaaaagaaaaaagggtttatgcttacgtctctggggtcggggggattatgtcacgagcgttcaaactgctggaaatctcaaaactgtactgtctttatttttgtatattgtatttatatataaaaagaaacgtctacgtatgcatgctaaattattatttagcttctcccatcgcccacgatggaatgtaaaataaattggttttgtactggat

SEQ ID NO: 385 - DNA, 3898 bp, Homo sapiens
cgagtgcgtgaagtgaaggcgattgagaggggctgagggaattgtcctctgtggaagggactttcttttggccctaggccccttcctgcccctgtcgtcagcagagtctctacaaggaagataacggactgtaaaattctataaagcaaagctacacatcacttgacaccatacaccatcttggttacataatgaagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgttacatgaaggaactggaacagtatcagaaaacagaggcctacaaggtcttcagtaggaaaacccaggaccgtcagaaaggcaaatctcataggcaagatgcagcccggcaggccactcatgatcatgagaaagaaacagaggtaaaggaacggtctgtttttgacatccctatatttacagaggaattcttgaaccatagcaaagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggaagtggagagacacctacagtggacaccattgactcatatatgaacagactgcacagtattattttagctaatccccaagacaatgaaaacttcatagctacagttcgagaagttgtgaacagactcgatcgttagggaatggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttgctgtgttgcccaggctggagtgcggtggctattcacagatgctatcatagcacactacagcctccaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaattcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttgaaaaaaaaaaaaaaa

SEQ ID NO: 386 - DNA, 1584 bp, Homo sapiens
gttggttggagcgtcgcgcagtcgggaggtccgggaaagtttctttggaggtccggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 387 - DNA, 1998 bp, Homo sapiens
catttgcatggccccgccccctgagtgacacggctggcgcgggcgggcccgtcccccctgcccctgggtcgctctttttaagctcccctgagccggtgctgcgctcctctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccaccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctggaaaaaaaaaaaaaaaaaaaaaaaaaaaaaaaaaaaaaaa

SEQ ID NO: 388 - DNA, 4150 bp, Homo sapiens
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggccacaacaagttgttcagaagaagcctgctcaggaggaaactgaagagacatcctcacaagagtctgccgaagaggactagggggcgccaacgttcgatttctacctcagcagcagttggatcttttgaagggagaagacactgcagtgaccacttattctgtattgccatggtctttccactttcatctggggtggggtggggtggggtgggggaggggggggtggggtggggagaaatcacataaccttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaaggggggggcaatctctctctgtgtctttctctctctctcttcctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaacagaaaaaaaaaaa

SEQ ID NO: 389 - DNA, 3428 bp, Homo sapiens
tggagagtaatgttacagagcggagagagtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaatactagttaaatggctttcacttaagaacttaagattttgttacatatttttaaatcttgtttctaataatacctcttagcagtaccttttaaataagtataagggatggcaaagtttttccctttaaaaatactcactttatgcttataaataggttaatgggctgataaaaggttttgtcaaacattgcaagtattcggtgctatatataaaggaggaaaaactagttttactttcagaatgatttaaacaagatttttaaaaacaagatacatgcaagcgaacagcagggttagtgataggctgcaattgtgtcgaacatcagattttttgttaagaggagcaaatgactcaatctgatttagatggaagtttctactgtatagaaatcaccattaatcaccaacattaataattctgatccatttaaaatgaattctggctcaaggagaatttgtaactttagtaggtacgtcatgacaactaccatttttttaagatgttgagaatgggaacagtttttttagggtttattcttgaccacagatcttaagaaaatggacaaaacccctcttcaatctgaagattagtatggtttggtgttctaacagtatcccctagaagttggatgtctaaaactcaagtaaatggaagtgggaggcaatttagataagtgtaaagccttgtaactgaagatgattttttttagaaagtgtatagaaactattttaatgccaagatagttacagtgctgtggggtttaaagactttgttgacatcaagaaaagactaaatctataattaattgggccaacttttaaaatgaagatgctttttaaaactaatgaactaagatgtataaatcttagtttttttgtattttaaagataggcatatggcatattgattaacgagtcaaatttcctaactttgctgtgcaaaggttgagagctattgctgattagttaccacagttctgatgatcgtcccatcacagtgttgttaatgtttgctgtatttattaattttcttaaagtgaaatctgaaaaatgaaatttgtgtgtcctgtgtacccgaggggtaatgattaaatgataaagataagaaaa

SEQ ID NO: 390 - DNA, 1527 bp, Homo sapiens
ggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattatttctattgtctttgtcttaatatgctaagttaattttcactttaaaaaagccatttgaagaccagagctatgttgatttttttcggtatttctgcctagtagttcttagacacagttgacctagtaaaatgtttgagaattaaaaccaaacatgctcatatttgcaaaatgttctttaaaagttacatgttgaactcagtgaactttataagaatttatgcagttttacagaacgttaagttttgtacttgacgtttctgtttattagctaaattgttcctcaggtgtgtgtatatatatatacatatatatatatatatatat

SEQ ID NO: 391 - DNA, 3556 bp, Homo sapiens
ggctctcgtggaggcagctagcgcgaggctggggagcgctgagccgcgcgtcgtgccctgcgctgcccagactagcgaacaatacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaa

SEQ ID NO: 392 - DNA, 1989 bp, Homo sapiens
agctgggccaatgaacggcggcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcattgttgtttttgggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatcgttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaatgctgcctctgatcttttcccacaagtggggtaacctggtttatccaagtctcttggaacagggtacgttctgctttgaggtactccatgtacagtctaatgatgatctttcactgatttatagtcagcttccaaaacacacagtgctaggtgcagttaggaaggattccaggagtagacttagctgatggtgaaaggctgggagtatggagtgatttctgtacttggttatgcagcattccctgcagtgtttgttttttgcatgactccgaatacatgaagtgtattaaatgcagatttttggtagatctgcggttttggctgggtagctgacaggagcctctctacttccatctgcatttgcaacttctataaaattagcaaattaatagactcatgtcagagagtgtctctgtgaatgtgtacacagttgtccatttgtaaggtagatgacactttgctcctaagtagacctgcaaacaaagacaatggggtctttcctgattcctttagtttggagatgcagagaaccccacgtttctctaagtgaaatggcaagaagttatttgttagaatatggaactggtaacaaattcatgtttgcaccttgaatttgctttcacagacctggctgtattgttggacaggaataaagtaaattggagactaaaaaaaaaaaaaaaaaaaaaa

SEQ ID NO: 393 - DNA, 1896 bp, Homo sapiens
ccgatcagctgtcggcgcgcactcgctcccggcccggcccagcccagcccggcgcggaggccgccgcctgccctgcggggcccgacgccagcggtccgggtagcagctccagggccggcccgcgcgtgcgcccgggagccgcgcgccaccatccccagcggggaccgaggagcccggccgagcccgagaagcccgcggccgcgatgcctgacgagctgacggagcccgggcgcgccacgccggcccgcgcctcctccttcctcatcgagaacctgctggcggccgaggccaagggcgcagggcgcgcgacccagggcgacggcagccgggaggacgaggaggaggacgacgacgaccccgaagacgaggacgccgagcaggcgcggcggcgacggctacagcggcggcgacagttgctcgcgggcaccgggcccggcggggaggcgcgggcccgtgcgctgctcgggccgggcgcgctgggcctcggtcctcggccgccccccggtcccgggccgcccttcgctctgggctgcggaggcgcagcgcgctggtacccacgggcgcacggtggctatggaggcggcctcagtcctgacaccagcgaccgggactcaccggagacgggcgaggagatgggccgtgcggagggcgcctggccgcgaggccccgggccgggagcggtgcagcgggaggcagcggagctggcggcgcgtggcccggcggccggcacggaggaggcgtcggagctggccgaggtccctgcggcggctggggagacacgcggcggcgttggcgtgggcggcggccgaaagaagaagacgcgcacagtcttctcccgcagccaggtcttccagctggaatccaccttcgacctgaagcgctacctgagcagcgccgagcgcgccggcctggccgcctccctgcagctcaccgagacgcaggttaagatctggttccagaaccgccgcaacaagtggaagcggcagctggcagccgagctggaggcggccagcctgtccccgccgggagcgcagcgcctggtccgcgtgccggtgctctaccacgaaagccccccggccgcagccgccgctgggcccccggccaccctgcccttcccgctggcgcccgccgcgcccgcgccgcccccaccgctgctcggcttctccggggccctcgcctacccgctggccgccttcccggccgccgcctccgtgccctttctgcgggcgcagatgcctggcctggtgtgagccccgcctgccgggccctctccccacgaccctgtggacctgtgtggacgcgcgattcagcggcaggcgcagggctcagggggcgttagggaagggatggtcgctcctgcggcctcctagatacctcgggagcgcaggccgcggccgggcgggcctcagcttctgtggggagcgcctctagaatgtaatgggacgccccacccatttgccaggctggatccccactcgaacagggggccatgcagagactctgggctgcgcagcccccggcgccacggccaccccccggcctcagcgaggagcggtcggccatggccacccggggcagctgccctcaggccaagcccagcgcaacaaaggaaaactacgaaccggctgtccaaggctgagcggtgactgtccccacagactgcccccaacactaaacgtccctttcctgggacccagacagcaggccggcccggagggctgtgctacccctctcgcgggtgctggtggagaaaggaccctggacctgtgggtcccatcgtccgttccaggagcaggcaggctggggctctctgcagacgtcgcagcctccgggttgttgtttttttaaatgaatctacttatttgcgtatggaataaaaagggacattttctggac

SEQ ID NO: 394 - DNA, 1628 bp, Homo sapiens
cgggcgaggaaggggcatttgcaccggggctgggcgggcgcacccagagccaggcgggcaggaacccctgcgcagccatccggtgcctgcatgtccctggcgcggaagggacgcctcaccagcctcggcgccccctccccctagatttcctccccgcccctccccactgcctgcctgctgcaccaccttccacccagatcacccagatcgtctctaaagggagttcttggtttccttcgatttcttatgaacccaggatgggcagcaaagaagatgcgggcaaggggtgtccggcggccggtggcgtctccagcttcaccatccagtccatcctgggcgggggcccctcggaggcaccgcgggagcccgtcggctggccagccaggaagcgcagcctgtccgtgtcctcggaggaggaggagccggacgacggctggaaggcgcccgcctgcttctgcccagaccagcacggccctaaggagcagggccccaagcaccatccccccatcccttttccttgcctgggtacccccaagggcagcggaggctcgggcccgggcggcttggagcgcacgcctttcctctctccttcgcactcggactttaaagaagagaaagagaggctcctgcccgcgggctcgccctcgccggggtccgagcggccgcgggacggcggcgctgagcggcaggccggcgcggccaagaagaagacgcgcaccgtcttttcgcgcagccaggtgtaccagctcgagtccaccttcgacatgaagcgctacctgagcagctcggagcgcgcctgcctcgcctccagcctgcagctcacggagacccaggtaaagacttggttccagaaccgccgcaacaagtggaagcggcagctctcggctgagctggaggcggccaacatggcgcacgcgtcggcgcagactctggtgagcatgccgctggtgttccgggacagttcgctgctgcgcgtgccggtgccgcgctcgctcgcctttcccgcgccgctctactacccgggaagcaacctctcggccttacctctctacaacctatacaacaagctcgactactgaccggcccgccgccccgcgccgcccccagctgcccgcagagccgggcgcgtactgtactgtaagcagggctccggagcaaggcggcgtgtttccagaaatatgaagaaatacaccatgtgtattcattagctcttatttatggtctctgccctactttttgttttgattgtttcgggtatttattggcattccctaagtcagagagcctgcttcctacctagaccgaaccagtacgctttgaaaaccattcggagtgagatgttctcgggtggtggtgggaaagggagttttggccagacaggctgtggttggtagggaaaaaaatcaggaaaacacctacaaaaccaggtacactcctcccccatatatacacctgtatatatgtacatgcatacacgctcggccaagccaggccctcagaggctttggacaattactaaattgcttcttttcgtttccctcatcccgaggatggtagggacgaaaaggggagagttcagatctgtaaatatttttaaaaagaaaaaaaaataaaacattttaaacatc

SEQ ID NO: 395 - DNA, 1335 bp, Homo sapiens
atgagtcttaaatgtctgcctcatgggcttctcgtgcgaaccggggagctgtttttaaagccagtggagtggaatgtcctttcactaagccgttctgcaaaggtccagtgtggttctctaaggacttcgctgccgtcgagacgcgcagcggatgccgctgcttgccgcggcggaggaagctacgccgctgcgccttcggttcaccttgcccccattaaagcgttagttagacagctccaaacgccagctggccggagagacttcctgggagaaagtgctgtcgtcggggtcacagactcggagttgatccgcgagccttgggcaccggcggccagagcagaggggtgcccttccgagagcagccgtcggtgccgagaagctgttgccccagcagccccaccgagtgacgcgcgggttttggccgggtcagcgcgcatacgcacacaggcacacccactcctggtcccgggggaaggctcactcttcggttttccagggctaaaggccaaggccacgcggatttctgagtccgaagacgcagtgcgaggacttacacctggattcccttactatcggctggatgttgagttccgtttatggtctgatttccggcctctcgcctgctcgccccgccgcccgcctgtgggcgacctggctttccctcgctttgagatcccggcgcagaggtttgccctgcccgcgcactacctggagcgctccccagcctggtggtacccctacaccctgacccccgccggcggccacctcccgcgacctgaagcctcggagaaggccttgctgagagactcctcccccgcctccggcacagaccgcgactctccggagccactgctcaaggccgaccccgatcacaaggagctggactccaagagcccggacgagatcattctggaggagagcgactccgaggaaagcaaaaaggaaggcgaagcggcgccaggcgcggccggggcgagcgtaggggcggcggcggccactccgggcgcagaagactggaagaagggcgctgaaagtccagagaagaagccggcgtgccgcaagaagaagacgcgcacagtcttctcgcgcagccaggtcttccagctcgagtccaccttcgacatgaagcgctatctgagcagctcggagcgagccggcctggccgcgtccctgcacctcaccgagacgcaggtcaagatctggttccagaaccgccgcaacaagtggaagcggcagctggcggcggagctggaggcggccaacctgagccatgccgcggcgcagcgcatcgtgcggtgcgttgctaggctcctcaaattcaatcgacacaattga

SEQ ID NO: 396 - DNA, 3239 bp, Homo sapiens
gggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattca

SEQ ID NO: 397 - DNA, 4101 bp, Homo sapiens
gagggtatcagaaccaatactggacatggacatggcaaattacagtgaagttttggacccaacttacacaactttggagtttgaaactatgcagattctatataattcaagtgatagttctgccccagagacaagtatgaataccacagacaacggtgtcaactgtctgtgtgctatctgtggggacagagcaacaggaaaacactatggggcatccagctgtgatgggtgcaagggtttcttcagacgcagcattcgtaagagtcacgtttattcttgcaggttcagtcggcaatgtgttgttgacaaggacaaaaggaatcaatgtagatattgtcgattaagaaagtgttttagagcgggaatgaaaaaagaagctgtacaaaatgaacgtgacagaataagcaccagaagaagcacatttgatggcagcaacatcccctccattaacacactggcacaagctgaagttcggtctcgccagatctcagtctcaagccctgggtcaagcactgacataaacgttaagaaaattgcaagtattggtgatgtctgtgaatctatgaaacagcagctcttagtcttggtggaatgggctaaatatattcctgccttctgtgaattaccattggatgatcaggtggcactgttgagagctcacgcaggggagcacttactgcttggagctacaaagagatccatgatgtataaagatattttgcttttgggaaacaactatgttattcaccgcaacagctgtgaagttgagattagccgtgtggccaatcgtgttctagatgagctggttagaccatttcaagaaatccagattgatgacaatgagtatgcttgtttaaaggcaattgtattttttgatccagatgcaaaagggctaagcgatccagtaaaaattaagaacatgaggttccaagtgcagatcggtttggaggactacatcaatgatcggcagtatgactcccgggggaggtttggagagttgcttctgctcctgcccacactgcagagcatcacgtggcaaatgattgagcaaatacagtttgttaaactttttgggatggttaaaattgacaatctacttcaggaaatgctattaggtggggcttccaatgatggcagtcatctccatcatccaatgcatccacatttgtctcaagacccattaactggacaaactatacttttaggtcccatgtcaacactggttcatgcagaccagatctcaactcctgaaaccccactcccttccccaccacaaggctctgggcaagaacagtacaaaatagctgcaaaccaagcatcagtcatttcacaccagcatctctccaaacaaaagcaattgtgaaaatgtgtttacttcagaacggcactacataaatgtgaaaagttgttgatcttgaaatatctcaggatagcacttttggcaaactcttagccaaggcttcttcattggtgctgttataagatggtgtcctattttcttgtttatacgttcattctgtttgttattgctactatgtaaaactttcacatgcaaccaatgtatatctgagtttgaagatgtttatatagggtattttttccaactgcccctgcattgtgcctgaaccaattgaatcttatgtatgagtttcatttgttttattaatgttaatttaaatctgtaaataattgctttattgtgatgtgatacagaacaaagtgttcgtttttgactgaaaatagtagatcagaaatctcagtttaatataaaatgagctaagtttttaaaaataaattataaacttggagattagaaaaataaagcagttgctgtagaataggctgtatctttttcaagaagaatctcttatggacagtctgtggtaaagaagcaactctttgctttagagttaaatattcctatcttaagtttagaaaaatacaaaaaaccattccaaggatgactggatactttttgaaatctgactttctttgaagatgtatgttaagcaaaaacatgttgcttttatcagttaggatacagggtgaactgtaacaaagaaacccctaaaacagtgactaaatcaagagaggaatctatttctttctcctgaaacaatttagaaaatagttatccattgactagaaattagtacatgcccacagctggctcccacggtagccaggagaattatctataggtggaaagtctgtgtcagccaaagccatgtcactctgagagaactgattctgaggacaagttagccatctaccacccatgtcccttatttggtcctcacaataacactttaggagagatatcattatcgctgttttataaataagggaaactttagcttgagggtttaaggaacataaccaaagttcacaaacataacgagtgagagaaacacattcaagcccaggtctagttgactttaatgaatctttggtgtggaatgaaaaatgtgaacttcttactcatagtgtggtttttaaatatatgcagttgagtgatgattggatactattcatcatattgcctataatatatatttaccgataagcagtgagtgtaaaattgttgtagcttgaataagaaaccacttttgtagttttaaccagactttctcttaaaaacattagataaaataaaagattcaccggatggattctgatgaaaacgaaaacaaagtaaaatgactggcttagcagattctttgaaatgtagcagcccagggatgtaccaaatgtcgaattctagactgaggagtagagttcattggagtcttaaactctctgatatcacttaaagctggagtttattttaaaacaaatgaagcatgggccacctcatgatgcagtggctcctctctggttgaggagagggaaaattggaaaaactggtcgagtaattatcaataattttttttaaaaagaggatcccaaactgtaaaagattgaaataatctttctcaggattttttaaatgtctaagattatgatgtcatatctcccacttaccttataagtaaaaaggttaatatcaagtaacttattagctcttaaagtaaaattgaacttattaaaagctatctatgatttaatagatttaataaaattccttcacgacctggtacccttgtgaaactgtaaaatatatcatatggggggagttttttaactcttattttttgaaaatttactgtagcttctatttcgtgaataagaatgttttgattttgatcatacaaataacttttgtagatttttgtttacttttgggggggttcccttagaagacattaaaaaaaaatactgccttggtctgtgcaggctgctgtaatgaaatactatgaacttggcagcttataaacaacagaaatttatttctcgctgttctcaatggtgggaagtccaagattaagggatcaacaaattaggcctctggatcatacatggcattttctagctgtgtccttatacataaaaggaaaaaggtagctctctcgagtctctttaataaagatactaattctcatgactgaatcaccctccaaaggccccacctcctaataccatcactctggggactaggtgtcagcatgtgaattttggaaaacacaaaaattcagaacatagcaaatacctttgaagtataaaagataaaattcatttttagtgaaccctgtaatttattcgtgtatatttactaaacagctgtatctttgaaattgttagtaatgattctgcttcaataactatggtcagggaatttataatattatatttttatatactgaactgccatagatgctggaaaaaaggaactgatgttttcagcatattttcaaaatattgataagggaagttattacttttatatagtattcaacttttttcaggtaatagaagtgaataatttattgtgaaataattcattttataaatgtataattatttttataaattttattgttggaaatcaaaaattagtagattttttaccatgttaaattatagtgagattaaagtattactaaactgtgatgctatgtttgtttcactaaactttctaaataaaaactgagaaaaaaaaaa

SEQ ID NO: 398 - DNA, 1552 bp, Homo sapiens
gcaccagatctacgctttgaaatgaggcaacatctaactggaaactcgctcaaagtaaggaagtggatgagaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccacactaatgacagactgccccactgagaagggtctagcggagcacaggtcaccagctgggcaacattcagaaagttagtcttcctatgctcattttcctgggctgttacagaagaagactggaagagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaagatgcactgaaaaaaaaaa

SEQ ID NO: 399 - DNA, 2561 bp, Homo sapiens
attcatatcatttttcttctccggccccatggaggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcaccacccccagccggctacctaccagacttccgggaacctgggggtgtcctactcccactcaagttgtggtccaagctatggctcacagaacttcagtgcgccttacagcccctacgcgttaaatcaggaagcagacgtaagtggtgggtacccccagtgcgctcccgctgtttactctggaaatctctcatctcccatggtccagcatcaccaccaccaccagggttatgctgggggcgcggtgggctcgcctcaatacattcaccactcatatggacaggagcaccagagcctggccctggctacgtataataactccttgtcccctctccacgccagccaccaagaagcctgtcgctcccccgcatcggagacatcttctccagcgcagacttttgactggatgaaagtcaaaagaaaccctcccaaaacagggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatcttctcatcttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactcaagtttcaggtatgcttaagcatccgtgtatttggctgggctacaatttgttaattcctatgaagttggcacatttcatgaggggaaagggagaagggtggtaaatattttcaaagagatgggccttttcttgaataaaagttaataacagctcctttattataatcaaagctcataatggaaaaaaagactgatgaagaaatttatgaagcagatttatttttgaaacaaacatggatacttcctgggtcaagtgctaaccttttcacctccaactggatgttgacgtatatataaacagaactcccttcaaaagccaaaaaaaaaaaaaaaa

SEQ ID NO: 400 - DNA, 2648 bp, Homo sapiens
taatcgtattcagcatgttttgcacaagaaatgtcagccagaaagggctatctgctcccttcgccaaattatcccacaacaatgtcatgctcggagagccccgccgcgaactcttttttggtcgactcgctcatcagctcgggcagaggcgaggcaggcggcggtggtggtggcgcggggggcggcggcggtggcggttactacgcccacggcggggtctacctgccgcccgccgccgacctgccctacgggctgcagagctgcgggctcttccccacgctgggcggcaagcgcaatgaggcagcgtcgccgggcagcggtggcggtggcgggggtctaggtcccggggcgcacggctacgggccctcgcccatagacctgtggctagacgcgccccggtcttgccggatggagccgcctgacgggccgccgccgccgccccagcagcagccgccgcccccgccgcaaccaccccagccagcgccgcaggccacctcgtgctctttcgcgcagaacatcaaagaagagagctcctactgcctctacgactcggcggacaaatgccccaaagtctcggccaccgccgccgaactggctcccttcccgcggggcccgccgcccgacggctgcgccctgggcacctccagcggggtgccagtgcctggctacttccgcctttctcaggcctacggcaccgccaagggctatggcagcggcggcggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaactataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaattttaaaaaaaaaaaaaaaaaaaaaaaaaaaaaaaaaaaaaaaaaaaaaaaaaaaaaaaaaaaaaaaaaaaaaaaaaaaaaa

SEQ ID NO: 401 - DNA, 2653 bp, Homo sapiens
cttcaaagaggcagctgcagtggagaatcatgttaagctcggctactgcggagagcccaaggtagcccaataatggattttgatgagcgtggtccctgctcctctaacatgtatttgccaagttgtacttactacgtctcgggtccagatttctccagcctcccttcttttctgccccagaccccgtcttcgcgcccaatgacatactcctactcctccaacctgccccaggtccaacccgtgcgcgaagtgaccttcagagagtacgccattgagcccgccactaaatggcacccccgcggcaatctggcccactgctactccgcggaggagctcgtgcacagagactgcctgcaggcgcccagcgcggccggcgtgcctggcgacgtgctggccaagagctcggccaacgtctaccaccaccccacccccgcagtctcgtccaatttctatagcaccgtgggcaggaacggcgtcctgccacaggctttcgaccagtttttcgagacagcctacggcaccccggaaaacctcgcctcctccgactaccccggggacaagagcgccgagaaggggcccccggcggccacggcgacctccgcggcggcggcggcggctgcaacgggcgcgccggcaacttcaagttcggacagcggcggcggcggcggctgccgggagacggcggcggcagcagaggagaaagagcggcggcggcgccccgagagcagcagcagccccgagtcgtcttccggccacactgaggacaaggccggcggctccagtggccaacgcacccgcaaaaagcgctgcccctataccaagtaccagatccgagagctggaacgggagttcttcttcagcgtctacattaacaaagagaagcgcctgcaactgtcccgcatgctcaacctcactgatcgtcaagtcaaaatctggtttcagaacaggagaatgaaggaaaaaaaaattaacagagaccgtttacagtactactcagcaaatccactcctctaagactccagcggctggaattgggtggggggcttcatacacatgagataatatgcagattttgcccttgacaaagtcaagccacatggtgacttttgaaaagaggtgtgcaagagagggatgcatggagatagccccacaggaggtggtctgggactctcttgattaagatctcagtggttaagattcctaataatcattggattctgagagctgtgcatcagctagaatgacaggtttgggacccctggtggttcactcttggagcctgcagagctgcgggctgggtgtggtctccactggggattgggcccctgccagaccccctggagactaaccccaccacaccctccctctactgggagcctacccacccccaggacccctgagtaaaaaagctgtgtgctctccaagcccagttcagcttggggacaggggcaggaggaaggggtaggattactaggtgcccagaatgaggctgctttccaaagccaatgtgaacagcggctggacttggaggtagctttgaggtggaagagggctgcaaatccttgtgggaaaagaaatctatgattccaggtggcatcagtgtctttccactcctcctagccacccaccacactgatccagccctgagttcctagccaccgcctcctacagcccacctggcttttctttctaccaaatgagggtcttggttccagcctgccactcaggcccaaagcctcgacacagagtggactgttccctgaggtgggagatgtggaaaagccaagaggctgcagccaggccactggcccctgagatctctgcaggaaatggctgtggagtgtggcagtttggcaaactctccaccacacgtaatgaaacttggatttgctcagtgtctggctgcagagcagtgggcctggccagcaggtccccagctttggctatgagggccttgagtcccccaaaacaccgggttccagcaccacactcagccctcattggctcttgaactgagcttggaagcttctggtgaccttccaagagcctgagagtgaggtggaattattttaaaagataaatattatattatatatatatatatttccctgaaggaaccaaagcgaattttaaaagatgcaatgtagaggggaaaagagatgatgaaaatatttaaaggccctatctgtttacagtgttccgtggttaaactcgctcactgctaagaatatttgaatgtatgcttcatacagggatggtgttcaaaaaacttgtaaataaaggaaccataatcaattttcttttctttctttctctttttcttttttcttttgccattagttgatttcctttagggtgttggagggggtggaaaaggtattgagaatggtctttttaatctcttgcaacatttggaaagagttagggaaatgctcagaggcagtcggcctggccggcctggggatctcatctgggaaagccaggcaccctcccattgaatctcctttgcctccctgtgttaagaaatgtctgttggctccatttgtactgggagtgttggcctgtcctcaattctggttcttacccaccgtgtgtgttgcagcacttatacaggcaactgggcacaaggaaaataaagacggtggaaatttga

SEQ ID NO: 402 - DNA, 2514 bp, Homo sapiens
actggggtcttctccatgcggctcgggctatgacagcctccgtgctcctccacccccgctggatcgagcccaccgtcatgtttctctacgacaacggcggcggcctggtggccgacgagctcaacaagaacatggaaggggcggcggcggctgcagcagcggctgcagcggcggcggctgccggggccgggggcgggggcttcccccacccggcggctgcggcggcagggggcaacttctcggtggcggcggcggccgcggctgcggcggcggccgcggccaaccagtgccgcaacctgatggcgcacccggcgcccttggcgccaggagccgcgtccgcctacagcagcgcccccggggaggcgcccccgtcggctgccgccgctgctgccgcggctgccgctgcagccgccgccgccgccgccgcgtcgtcctcgggaggtcccggcccggcgggcccggcgggcgcagaggccgccaagcaatgcagcccctgctcggcagcggcgcagagctcgtcggggcccgcggcgctgccctatggctacttcggcagcggctactacccgtgcgcccgcatgggcccgcaccccaacgccatcaagtcgtgcgcgcagcccgcctcggccgccgccgccgccgccttcgcggacaagtacatggataccgccggcccagctgccgaggagttcagctcccgcgctaaggagttcgccttctaccaccagggctacgcagccgggccttaccaccaccatcagcccatgcctggctacctggatatgccagtggtgccgggcctcgggggccccggcgagtcgcgccacgaacccttgggtcttcccatggaaagctaccagccctgggcgctgcccaacggctggaacggccaaatgtactgccccaaagagcaggcgcagcctccccacctctggaagtccactctgcccgacgtggtctcccatccctcggatgccagctcctataggagggggagaaagaagcgcgtgccttataccaaggtgcaattaaaagaacttgaacgggaatacgccacgaataaattcattactaaggacaaacggaggcggatatcagccacgacgaatctctctgagcggcaggtcacaatctggttccagaacaggagggttaaagagaaaaaagtcatcaacaaactgaaaaccactagttaatggattaaaaatagagcaagaaggcaacttgaagaaacgcttcagaactcgttgctttgcccagataatgataataatgcttaataataattgaagaatgggaaagagaaagagacagagactggcattttcctctcccgaaggagatctctttctctttaatggaatctacaactgttttaaaactttaagaaaggtaaagactgccagttcttccgccaaccccatcagcccagcccgttaaatgtcaaacgtcaacccccaaaatacgcaatttcagataagttacgcagttactgaaatcttgtaagtatttaagtgatcgttacattttaggacactgcgttagatggtaataatctggaagttggttacaaacgcaagaggccattgtaaacatctgcttgtccttcttaggtcgccattccctttgcatgttaagcgtctgctcaggtaaatcttagtgaaattcctaccgttgttgtacgttctgcaaaacattttatgtatagatttagaggggaaacgagaaggtactgaaataatgatcttggaatatttgctgtgaagggagaaagggagagaaaactcttctgaggatcatttgtcttggtagtatagtaaaaccaaccagctgaacctttcaggctacaagagaacccgggtcggtaatgtctttttaagaataatttttaattgcttataacaagcatattttgtggcatttgaactatatttactgctccaatatccgttattttccaaaggattttgtatctttttgaaaatgtttacatcatcagatgatccacagaattcactttatgtgagatctcccgagagtttccatcccaacatgatggactttggtttgaacacaattcgttttttcatttgaattggcatttcccaatatttgctaaacatttgctggagaaatcatttttcttttttcttttttagaaaactcagaatgaaaattcattcccctgaaatatttaggtgtctatattctatattttgatctattaagggattagtatttttccatgtttattgtgttatcagagtgcattagaaagattagtgattcatcttcacagcacatttttaatcaagcagttatttcaaccagcacattcgttttgttcatattcactatagaatgatatcttgtaaataaagacattcagcacactgtgaaaatgtatttgtgcacctgctttttaaatatttctactaaaaatgaaaaaaaaaaacccttagacctgtagatagtgatatcgtaatattaattgttaataaaatagtcactgcc

SEQ ID NO: 403 - DNA, 1791 bp, Homo sapiens
tcttttgattaaagcccaaattgtcattgggcagaagcaatcatgtgacagccaattcggtccaatttcaaccttgtctccatgaattcaatagtttaatagtagcgcggtccccatacggctgtaatcagtgaattagaaaaaaaacaccctagcagcgatattctatgatagattttttttcctctgcgctcgcctttttcctaggccttgcccccccaaagcccctccaaaagagggaactttttctctgagggggctccaaggagaaggccatgaattacgaatttgagcgagagattggttttatcaatagccagccgtcgctcgctgagtgcctgacatcttttccccctgtcgctgatacatttcaaagttcatcaatcaagacctcgacgctttcacactcgacactgattcctcctccttttgagcagaccattcccagcctgaaccccggcagtcaccctcgccacggcgctggcggccgccccaagccgagccccgcgggcagccgcggcagcccggtgcccgccggcgccctgcagccgcccgagtacccctggatgaaggagaagaaggcggccaagaaaaccgcacttctgccggccgccgccgccgccgccaccgccgcagccaccggccctgcttgcctcagccacaaagaatccctggaaatcgccgatggcagcggcgggggatcgcggcgcctgagaactgcttacaccaacacacagcttctagagctggaaaaagaatttcatttcaacaagtacctttgcagaccccgaagggtggagattgcagcgctgctggatttgactgagagacaagtgaaagtgtggtttcagaaccggaggatgaagcacaagaggcagacccagtgcaaggaaaaccaaaacagcgaagggaaatgtaaaagccttgaggactccgagaaagtagaggaggacgaggaagagaagacgctctttgagcaagcccttagcgtctctggggcccttctggagagggaaggctacacttttcagcaaaatgccctctctcagcagcaggctcccaatggacacaatggcgactcccaaagtttcccagtctcgcctttaaccagcaatgagaaaaatctgaaacattttcagcaccagtcacccactgttcccaactgcttgtcaacaatgggccagaactgtggagctggcctaaacaatgacagtcctgaggcccttgaggtcccctctttgcaggactttagcgttttctccacagattcctgcctgcagctttcagatgcagtttcacccagtttgccaggttccctcgacagtcccgtagatatttcagctgacagcttagacttttttacagacacactcaccacaatcgacttgcagcatctgaattactaaaaacattaaagcaaaacaaagcatcaccaaacaaaaactcctttgaccaggtggttttgccttcttttatttgggagtttattttttattttcttcttgacctaccccttccctcctttaagtgttgaggattttctgtttagtgattccctgacccagtttcaaacagagccatcttttacagattattttggagttttagttgttttaaacctaactcaacaaccctttatgtgattcctgagagcagtatgaggcctgcaagaaagtgatcatataattgtatcttcactttctttttatttttgtattacattgggatgcattgtcatgcatattttttgtagaataaattctcctttgctataagtaaaaaaaaaaaaaa

SEQ ID NO: 404 - DNA, 3257 bp, Homo sapiens
tctcactagcctcagagcactctcagaagttcagaaactaagaccagaaaagagaagatttttagacagctcatgaaacggtctgcgcggggcggccattggcggcggagtgtcacgtgaccgcgggggcgtgccaatgtgcgccctcacgggtgtcaaacccctgtcagagtgtgcgatcaagatcgtgaaacaacgcgatgcaaaaagcgacctactacgacagctcggcgatctacggtggctacccctaccaggcagccaacgggttcgcttataatgccaatcagcagccgtacccggcgtccgccgctttgggcgccgacggcgagtaccaccgacccgcctgctccctccagtctccctccagcgccgggggccaccccaaggcacacgaactgagtgaggcgtgcctgcgcaccctgagcgccccacctagccagcctccaagcctgggagagccgcccctgcacccgccgccgccccaggccgcgccccctgccccacagccgcctcagcccgcacctcagccccctgcacctacccctgccgcgcccccgcctccctcttctgcctcccctcctcagaatgccagcaacaaccctacccctgccaacgcggccaagagccccctgctcaactcacccacagtggccaaacaaatcttcccctggatgaaagagtctcgacaaaacacaaagcagaaaaccagcagctccagctcaggcgaaagctgcgctggcgacaagagcccgccggggcaggcttcgtccaagcgcgcgcgcacggcctacacgagcgcgcagctggtggagctggagaaagagttccacttcaaccgctacctgtgccggccgcgccgggtggagatggccaatctgctgaacctcactgagcgccagatcaagatctggttccagaatcgccgcatgaagtacaaaaaggatcagaagggcaagggcatgctaacgtcatcggggggccagtctccaagtcgcagccccgtgccccccggagccggtggctatctgaactctatgcattcgctggtcaacagcgtcccgtatgagccccagtcgcccccgcccttctccaagcccccccagggtacctacgggctgccccccgcctcctaccctgcgtccctgcccagctgcgcacccccgccacccccacagaagcgctacacggcggcaggggcgggcgcagggggcacccccgactatgacccgcacgctcatggcctgcagggcaacggcagctatgggaccccacacatacagggaagccccgtcttcgtggggggcagctatgtggagcccatgagcaactccgggccagccctctttggtctaactcacctcccccacgctgcctcgggcgccatggactatgggggtgccgggccgctgggcagcggccaccaccacgggccggggcctggggagccgcaccccacctacacggaccttaccggccaccatccttctcagggaagaattcaggaagcacccaagctcacccacctgtgatagtgggcttggggctacgcgccaggagagtctccccccacccaccttttttctttggttgcttttttttttttttttttttaggttcttcctgccctttccttccttccttttctctcttctccgccccgcactccgtttcccggtttcccccctcgttggtaaggcgtttttatagtttatgtgacgtagcaatcttggttgctggaatggctgtatcatagcgatatttatctcttcctgctcctcgataggccactggccctgcaccctttaccttctccactctttgatcagaaacagggtatatgaacaaattttctagtcgagttttcaatgtgaatttgttcttacattatggctcccgaggggaagcgattactttttttaattttaaattttttttttaattgcacttcttgtaaagagtgagaaaaaaaatcaaaggcgctttgaaacaggggctctctgtgcaaggatgactaagtgtacgtctttccgtgtgtgtatgctggtgaacagtcagatttatttatatttttttgcaagcattgaataatctaagttttaaatattatttatccccatccgttcgtatttatattaaagaattctgtaccctgatggttcagaagggttcttgggccttttgttcaattgtgtattggcgtacttagaattttttttatttgaaagagaaatataattcctttaaacggtaacgatacaataaaaccagagaagatccagcttttgaaaacagtgatttaggtttgtaacatccggcaaaactgaaaaaaaaaatctgtaaacgcgaaaaatactagatttgttttgagagttcttcattccttgctgctcacattctgagaaacaaaaagaaataaagtttttattctgaataatatccgtgttaagaaggggttctttggccgaagacgtgggtctgcgtggaattcaggccgaggcgagccggcagagcaggccggacgcagcagccctctggctccagcatggggcctggccaggctattcgcctggaagctcggcgaattctcaggatggcggctggggctccaggcggctgcggcagctctggtaacgccgtgcggcgggccagctgggctgcccggttcccagctgctgcggaggcaggctgagggcgcaggggctgccgagtgctgtgcacggaagaaacaaagacatcccggcccaaggcgcagcgggagcgcacaggtgccccgcggcccagccgggggataacgcagggcggtcttctgctccatgctcttcctcgggtcaaagcggaccaactaacgcctaaacctcggtattagccagccgcgcagaggatgccgagcactttccgggagcaatcggactcctggtctcctccggggatgcttcgcggtctgttatcgcgtcaggaggaaagaattgctccaaaaatctgcacgcggagcgaaacagtttgaaagggactgaggctcacccaggtctccagcaaacggaggactgaactggggagagtcaccctgagccagcccttccctggactgccggaatcccagcattagcttcctgctgaatgtagtatttggcattctctgaatttatttcctctccttcccccacccagctttctttttatggccccagggggagggggagagagcaaggagatcggtatctttgtaataaaactgcaattttataaatttttca

SEQ ID NO: 405 - DNA, 1728 bp, Homo sapiens
aaaacgacaacgcgagaaaaattagtatttttgcacttcacaaattaatgaccatgagctcgtttttgataaactccaactacatcgagcccaagttccctcccttcgaggagtacgcgcagcacagcggctcgggcggcgcagacggcggcccgggcgggggccccggctaccagcagcccccagcgcccccgacccagcacctgccgctgcagcagccccagctccctcacgcgggcggcggccgagagcccactgcctcctactacgcgccgcggaccgcccgcgagcccgcctaccctgctgccgcgctgtaccccgcgcatggggccgcggacaccgcctacccctatggctaccgcggcggcgccagccccgggcggccgccccagcccgagcagcccccggcgcaagccaagggcccagcgcacggcctgcatgcgagccacgtcctgcagccccagctgccgccgcccctgcagcctcgcgccgtgcccccagcggccccgcggcgctgcgaggcggcccccgccaccccaggcgtcccggcagggggcagcgcccccgcgtgcccgctgctcttggccgacaagagcccgctgggcctgaagggcaaggagcccgtggtgtacccctggatgaagaagatccatgtcagcgccgttaaccccagttataacggaggggagcctaagcgctctcgaaccgcctacacccggcagcaggtcttggagctggagaaggagttccacttcaatcgatacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtgaaaagaataatcaaaaagaagacattatccggttaagagtctgtgctggttgccacccaagagagaacagttgtccaggatgctggctggtggaacaacctgctggcccgaaacaaggctgccaggtgtggatacctgagaaggactacttggtatcaaatacttttgagatggctacagtcagctagctggacagcccatgctgagtggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgttacagagatactgttgtccccttctggggcacggtctttggggagaggggagtgcatttagacttatgtggaactgtacaaattgtgatgtggctacatagaaagccatgtgctaagaataaactccatttaaaaaacattaaaaatctaagattca

SEQ ID NO: 406 - DNA, 1332 bp, Homo sapiens
gggtgctatagacgcacaaacgaccgcgagccacaaatcaagcacacatatcaaaaaacaaatgagctcttattttgtaaactcattttgcggtcgctatccaaatggcccggactaccagttgcataattatggagatcatagttccgtgagcgagcaattcagggactcggcgagcatgcactccggcaggtacggctacggctacaatggcatggatctcagcgtcggccgctcgggctccggccactttggctccggagagcgcgcccgcagctacgctgccagcgccagcgcggcgcccgccgagcccaggtacagccagccggccacgtccacgcactctcctcagcccgatccgctgccctgctccgccgtggccccctcgcccggcagcgacagccaccacggcgggaaaaactccctaagcaactccagcggcgcctcggccgacgccggcagcacccacatcagcagcagagagggggttggcacggcgtccggagccgaggaggacgcccctgccagcagcgagcaggcgagtgcgcagagcgagccgagcccggcgccgcccgcccaaccccagatctacccctggatgcgcaagctgcacataagtcatgacaacataggcggcccggaaggcaaaagggcccggacggcctacacgcgctaccagaccctggagctggagaaggagttccacttcaaccgttacctgacccgcagaaggaggattgaaatagcacatgctctttgcctctccgagagacaaattaaaatctggttccaaaaccggagaatgaagtggaaaaaagataataagctgaaaagcatgagcatggccgcggcaggaggggccttccgtccctgagtatctgagcgtttaaagtactgagcagtattagcggatcccgcgtagtgtcagtactaaggtgactttctgaaactcccttgtgttccttctgtgaagaagccctgttctcgttgccctaattcatcttttaatcatgagcctgtttattgccattatagcgcctgtataagtagatctgctttctgttcatctctttgtcctgaatggctttgtcttgaaaaaaaatagatgttttaacttatttatatgaagcaagctgtgttacttgaagtaactataacaaaaaaagaaaagagaaaaaaaaacacacaaaaagtcccccttcaatctcgtttagtgccaatgttgtgtgttgcactcaagttgtttaactgtgcatgtgcgtggaagtgttcctgtctcaatagctccaagctgttaaagatatttttattcaaactacctatattccttgt

SEQ ID NO: 407 - DNA, 2711 bp, Homo sapiens
attttgcaaggagagctgagacgggctgctccactgtactttgttggctgagaagttgagcagggggtgggggtgggagggtggggggctgggggggtcgcgtccgaaagccctcacaccggtccgggtgccacctctccctgcttgggcgccgccgcgcgagcgcttcccttccccctgcaagcgcccggataatgtctgagaatgtccatttctgggacgcttagcagctattatgtcgactcgatcataagtcacgagagtgaggacgcgcctccagccaagtttccttctggccagtacgcgagctcgcggcagccgggccacgcggagcacctggagttcccctcgtgcagcttccagcccaaagcgccggtgttcggcgcctcctgggcgccgctgagcccgcacgcgtccgggagcctgccgtccgtctaccacccttacatccagccccagggcgtcccgccggccgagagcaggtacctccgcacctggctggagccggcgccgcgcggcgaagcggccccggggcagggccaggcggcggtgaaggcggagccgctgctgggcgcgcctggggagctgctcaaacagggcacgcccgagtacagtttggaaacttcggcgggcagggaggccgtgctgtctaatcaaagacccggctacggggacaataaaatttgcgaaggaagcgaggacaaagagaggccggatcaaaccaacccctccgccaactggctgcacgctcgctcttcccggaaaaagcgctgtccctacaccaaataccagacgctggagctagagaaggagtttctgttcaatatgtacctcaccagggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggtgtcaggagaaagttttgttgatttagaagatagaaatagttggttcctaagaatgtgatgggccacaaggaaagagagaccccagtcaagctcctagtatgccctgtaatttttctgggaagtcctagcccctcacttccagcttgcctgtttcttctctacacccacccaaaagtcacccagggacactccaactctacacagctcagcagacatccacacacagtaatggggtgagctcacaaccaccattcagtcaagtgaggtgacactccagttgcagaccatcgcacaccaaatttggcaaaacagccctcagactgtcaggcaagcccgggttctacccctaatgcaaatacccaccagggagatgtctagaggcagactcctgagtgaggtgttgcagcccaaaggctgcagcattgccataccattcccatggagttgccaactattctcaggccaagggccatggggaagatggagcaaacctagcccccaagccggtgggctagaaagtacaagaaaaggcagcacgtggttttatgaagctatcttaggtggagctactccccacctcccaccaacatatacattttgttgcaggaaatgtttaattccgcatgatgtttccctctccttccaacaaaagaaggtcaaactgtgggtcgtagagccttgacaatgttgtcctcctgttcatctgtgcaccacttgacagactgtagcttctcttgctctcgaccggccctgcattcttccgcaccctccctagctctgaaatcaactctcttcggtcgtatccaccttgcacccgcaagtcaagccgccccttgtagaaaaatccctccaccttccgttccccgctaggtcaaccccactgtagacaggaaagccaggccaggagagtccgaatgagaatttattgtgaatcgattcccaagctcccttccgggacaagtggtctgggacagggaggagcaacggccccagcgcgcaacgctctgcgcgttcctccgaatcccgtcggcttctcgacccacgcagagaagccccgggcttggcggctctagccccagcgccaaaggagacccgccccagggccgggcttggcctcctgcttcatgggcctggatgcagatctgcgtggctggtgcgtgcgcgcgcttctgggaaacagtcccgcgtgcaaaggaaaggggcaaaatggcacctaagcatcagatggaagcttactctctgcttccgttcctccccctgctcccctacttctcagtccccttcaatttgtagactcttgctcctgcttctcctgatcctgcaaggggacattccagtagaagttttttgctttgtcggtggctgtcgtgaaattgtgcttgtgtttcgtgatttctttgggggtgattgtctcgcttgttttcagttgtcgattatatgggagggttctgggtgggagtggggagggcgaggggcctagagctctaattgtttgttttggaagaaaaaaagaaaaagaacaaaaaatatatatcactctagaaaataaaaaaaaaaaaa

SEQ ID NO: 408 - DNA, 2017 bp, Homo sapiens
cctcccctccaaccgcgccccccctcccggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaagaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaagccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccccaaatattgtcctgtccctgtctgggagttgtgttatttaaagatattctgtatgttgtatcttttgcatgtagcttccttaatggagaaaaaaaaacctaataaatttccagaatcataatcctcaaaaaaaaaaaaaaaaaaaaaaaaaaaaaaaaaaaaaaaaaaaaaaaaaaaaaaaaaaaa

SEQ ID NO: 409 - DNA, 2100 bp, Homo sapiens
gtgctcagagagagagagactaagacggataacgcgtcatctcgccttcccaaattttcccccctcgctagaccgggtccaaaacctccatccggagccggcaggagaggagaacgatgtttaactcggtcaacctgggcaacttctgctctccgtcgcgcaaggagaggggcgcagatttcggcgagcgagggagctgcgcctccaacctctatctgcccagttgcacttactacatgcccgagttctccacggtctcctccttcctgccccaggccccctctcgtcagatctcctatccctactcggcccaagtgcccccggtccgggaggtctcctacggcctggagccatccggcaagtggcaccatcggaacagctactcctcctgctatgcggcggccgacgagcttatgcaccgggagtgcctgcctccttccaccgtcaccgagatcctcatgaaaaacgaaggctcctacggcggccaccaccaccccagcgccccgcacgcaacccccgccggcttctactcctcagtcaacaagaacagcgtcctgcctcaagccttcgaccgtttcttcgacaacgcctactgcggtggcggcgacccgcccgccgagcccccctgctccggcaagggcgaggccaagggggagcccgaggcacccccggcctcgggactggcgtcccgggctgaggcgggtgccgaggcggaggctgaggaggagaacacaaatcccagctcgtccggttcagcccactccgtggccaaggagccggccaaaggagccgcccccaacgccccccgcacccgcaagaagcgctgcccttattcgaaattccagatccgggaactggagcgagagtttttcttcaacgtgtatatcaacaaagagaagcggctgcagctgtcccggatgctgaacctgacggaccgacaagtgaaaatttggtttcagaacagaaggatgaaagaaaagaaactgagcagagaccggctgcagtatttctcgggaaatcctctgctgtaacctgcagaccgggcccttttgggggcggggggaggggaaaattattttattttatttttattttttattttctaactcgtcttctttccgccggtggaaaactggactgtggccagggctggcccccaccgctgtggccggcactccattccggaacctcctggaccctctatctgactctcgctgtgggacagggaccgggcctggaaagggggtgaagggaagtgtctgatgcacggcgagtgaacaccgttggcgccgaggccaagactttgatttaaaagaaaacacacctcggcgacaatgtcttgctgctcggattaggtgggggaggggcgacagtagtgagcgcctgagccgaacaatcctcgaactaaaagccttcccttgcccatgtgaaaagatccgctaagacagcatgtctgccagcggaaacttctcgagctcccccctctaccccgccccaccttgccccactactttagggggcagctaaatgtgatcctgccttgctgtgaaatttctgtaccttcaacctggtgttaggtgtgcaaagtccgtgtcctacctccgtcttcgccaaggccccgcccgagcctagttgttctccccctgaatgtgtagaaccttcctttgaaatttcttaatcggtgcattgaggtttccacatctttttccaagcagtgccccacttcatggatttatagctatagtctatgcagtcgttacctcttttttttttttttttaagaaaattgaagattggggtggtggaggcagtagggagatgggattgggcacctcccccgtgctggggcctggatttttgtaaataaatttcccaagcgtttctttccacctggagggaaagggggggacgcccccagtgagattcaaatcacgcatctctactcctctgcgtgagtgcgtgtgtacatgtgcactccccaccctgctcccttcccagagggattgctgtgaaatttttttggtggcaaataaagataaatttcattctgttcaaaaaaaaaaaaaaaaaaaaaaaaaaaaaaaaaaaaaaaaaaaaaaa

SEQ ID NO: 410 - DNA, 142 bp, Homo sapiens
ttgcaactggcagagctggagggcgagtttctggtcaacgagttcatcacacgccagcgccggagggaactctcagaccgcttgaatcttagtgaccagcaggtcaagatctggtttcagaaccggagaatgaaaaagaaaa

SEQ ID NO: 411 - DNA, 2435 bp, Homo sapiens
aggggtggagagaaaagaggggagggatggggggaggggaaacaggagcgaggtgtctccctagctcgctgcctctggcaagtggagtttttaaaaagctccagcagatcatgtcatgacgacttcgctgctcctgcatccacgctggccggagagccttatgtacgtctatgaggacagcgcggcggagagcggcatcggcggcggcggcggaggaggaggcggcggcacgggcggagcggggggtggctgcagcggagcgagccccggcaaagccccgagcatggatggtctgggcagcagctgcccggccagccactgccgcgacctgcttccgcaccccgtgctgggccgcccgccggctcccctgggcgcccctcagggcgccgtctatacggacatcccggccccggaggcggcgcgccagtgtgccccgccgcccgcaccccccacctcgtccagcgccaccctgggctacggctaccccttcgggggcagctactacggctgccgcctgtcgcacaacgtgaacctgcagcagaagccttgcgcctaccacccgggcgataaatacccggagccgtcgggcgccctgcccggtgacgacctgtcctctagggccaaggagttcgccttctaccccagcttcgccagctcctaccaggcgatgcccggctacctggacgtgtcggtggtgcccgggatcagcgggcacccggagccgcgtcacgacgccctcatccccgtcgaaggctaccagcactgggctctctccaatggctgggacagtcaggtgtactgctccaaggagcagtcgcagtccgcccacctctggaagtctcccttcccagacgtggttcccctgcagcccgaggtgagcagctaccggcgcgggcgcaagaaacgcgtgccctacactaaggtgcagctgaaggagctagagaaggaatacgcggctagcaagttcatcaccaaagagaagcgccggcgcatctccgccaccacgaacctctctgagcgccaggtaaccatctggttccagaaccggcgggtcaaagagaagaaggtggtcagcaaatcgaaagcgcctcatctccactccacctgaccacccacccgctgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaattcttgcctcatcctatgaccaggcttttagaggaccttccctaagggcgcagcttcggagcaggatctgtccagctcatactttccttcgctgtccctcccgcactccttaggcaagatttcccagtaaagattttctgtgcgtattttaaaagtcgtgttaatactcatgataattattagggacctggcagcgtgattggagtatggatgtttccgtaaaagctggaattccgtaaaagcattgacgcagcccctacactccatcccaaccaagaaactgcatttcctggggccaggtgggagctgcctttgccccactgcctcccctgttctgctctctcagtcaacatgtggaaatccaaggaggacaaagactccagccacgctgctaaatagggctcctctctcctctctctctctctaggtggtaaggttggggattagtccaggtacagaagcagaacttttttctaaggataaacatctcttccaaggggatggagagtgggtccctcaacaaagtccctgtccagtcacctttccatcagggcactagcccaggaatgactcctcacactttcacctttactgatttccagaggaaagctagaggatctagttcaagaggcaagaagatctggccctcaattagctagatgtagatgctgcctaacagttccctcctcaaaggccaccttggtgctgtgggggccccttgcctcttcccttcccactggtgcattacaaaacagtgttcttttgaaatgttcatcaggaataggcttttttaaaaaatgttgtgtatctgtatatagtattgtgatgtctgaatgacaatgtactgaatgcaaaaaggaaaaaaacccacaaacatgtttttaaaataaaatatctttttttgccttgaaaaaaaaaaaaaaaaaaaaaaaaaaaaaaaaaaaaaaaa

SEQ ID NO: 412 - DNA, 2300 bp, Homo sapiens
ttattgtggtttgtccgttccgagcgctccgcagaacagtcctccctgtaagagcctaaccattgccagggaaacctgccctgggcgctcccttcattagcagtattttttttaaattaatctgattaataattatttttcccccatttaattttttttcctcccaggtggagttgccgaagctgggggcagctggggagggtggggatgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcgcgggggctcaacccccagacctccagaaatgacgtcagaatcatttgcatcccgctgcctctacctgcctggtccagctgggaccctgcctcgccggccgcatggccagagggttggaaattaatgatcatgagctcgtatttgatggactctaactacatcgatccgaaatttcctccatgcgaagaatattcgcaaaatagctacatccctgaacacagtccggaatattacggccggaccagggaatcgggattccagcatcaccaccaggagctgtacccaccaccgcctccgcgccctagctaccctgagcgccagtatagctgcaccagtctccaggggcccggcaattcgcgaggccacgggccggcccaggcgggccaccaccaccccgagaaatcacagtcgctctgcgagccggcgcctctctcaggcgcctccgcctccccgtccccagccccgccagcctgcagccagccagcccccgaccatccctccagcgccgccagcaagcaacccatagtctacccatggatgaaaaaaattcacgttagcacggtgaaccccaattataacggaggggaacccaagcgctcgaggacagcctatacccggcagcaagtcctggaattagagaaagagtttcattacaaccgctacctgacccgaaggagaaggatcgagatcgcccactcgctgtgcctctctgagaggcagatcaaaatctggttccaaaaccgtcgcatgaaatggaagaaggaccaccgactccccaacaccaaagtcaggtcagcacccccggccggcgctgcgcccagcaccctttcggcagctaccccgggtacttctgaagaccactcccagagcgccacgccgccggagcagcaacgggcagaggacattaccaggttataaaacataactcacacccctgcccccaccccatgcccccaccctcccctcacacacaaattgactcttatttatagaatttaatatatatatatatatatatatatataggttcttttctctcttcctctcaccttgtcccttgtcagttccaaacagacaaaacagataaacaaacaagccccctgccctcctctccctcccactgttaaggacccttttaagcatgtgatgttgtcttagcatggtacctgctgggtgtttttttttaaaaggccattttggggggttatttattttttaagaaaaaaagctgcaaaaattatatattgcaaggtgtgatggtctggcttgggtgaatttcaggggaaatgaggaaaagaaaaaaggaaagaaattttaaagccaattctcatccttctcctcctcctccttccccccctctttccttaggccttttgcattgaaaatgcaccaggggaggttagtgagggggaagtcattttaaggagaacaaagctatgaagttcttttgtattattgttgggggggggtgtgggaggagagggggcgaagacagcagacaaagctaaatgcatctggagagcctctcagagctgttcagtttgaggagccaaaagaaaatcaaaatgaactttcagttcagagaggcagtctataggtagaatctctccccacccctatcgtggttattgtgtttttggactgaatttacttgattattgtaaaacttgcaataaagaattttagtgtcgatgtgaaatgccccgtgatcaataataaaccagtggatgtgaattagtttta

SEQ ID NO: 413 - DNA, 1613 bp, Homo sapiens
acccctcaacttcaaagagtcacaaatcacccttaatcaaaaagggtgcagaaatttttttgggccctccccgccatgagctcctacgtagccaattcattctataagcagagccccaatatccctgcctataacatgcaaacttgtgggaactatggatcggcctcagaggtgcaggcatccaggtactgctacggcggattggacttaagcatcactttcccaccgcctgcgccttccaactctctccacggggtagacatggctgccaacccccgggctcaccccgaccgccccgcctgcagcgccgcggccgctccgggacacgctccgggcagagacgaagcggctcctctgaaccccgggatgtacagtcagaaggcggctcgcccggcgctggaggagcgagctaagagcagtggggagatcaaagaggagcaggcgcagacagggcagcccgccggactgagccagccaccggccccgccacagatttacccgtggatgaccaaactgcacatgagccacgagacggacggcaagcggtcccgaaccagttacacgcgctaccagactctggaactcgagaaagaattccactttaaccgctacctcactcgccgcaggcgcatagagatcgccaacaacttgtgtctcaatgagagacagatcaagatctggttccagaaccgcaggatgaagtggaagaaagattccaaaatgaaaagcaaagaggctctttagaggcagcgggggaggcccgcagagcgcgcccctagccggttcctgtccctgcgcctttccttttcgcctttcctctctatatttcgggtcgggggcaggtgctggagcactgggctcccgggccccacagacaaaagcgcttttccttggcattccgcatccctaccgacccagggttcccgcggggctgtcggcgctgccccatctcccctcagctcggctcagctcggtacccggggcccagggcaagctccgcaggacttccccggagggctgcggcgtacaggctggcgcagaacgaaccttggcctgggccgtatctccggctcccagcctcagcgcggccctcccgagttaaggtgggcccggcccgcgccacaggaccctcgccggaccctctaacctcgccctctcctttgttcccggctggacgggttagacagccaaaggctggcgagagtctggccctagactcggggtgcttccttgtagcgactaaactagattttcacttatgaatgatttgcatatgaaaggagagcatcggcctagggcccccacagttgctctatgctttccaaaccttatctccacaacctcttccccccaaaacccgggaacctccccagcctgcgcctgctgcatgccctctcaggccggcagccccagcctgctagctagctcaactagtggggtttcctggcactggaccccagcaagtggtcctagaggccctttgctgtcccatagtccctgccacgaatttctgtgccctcctgacccattgctgttgtccaactatttattgactctgggtccttcctgaaactatattttgtcatatcaaataaagagagaacaggactaaa

SEQ ID NO: 414 - DNA, 1681 bp, Homo sapiens
ttttgtctgtcctggattggagccgtccctataaccatctagttccgagtacaaactggagacagaaataaatattaaagaaatcatagaccgaccaggtaaaggcaaagggatgaattcctacttcactaacccttccttatcctgccacctcgccgggggccaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattatttttaaaacttta

SEQ ID NO: 415 - DNA, 2290 bp, Homo sapiens
gccgagctcagcaccgaggcgccccccaacctgcccagcccccagcccaccagcccagcccagtcccggggagccagctggcctggggttcggtcccggggggaggggagtttcgggggtactgggcggggtactcgtgagccagaggggagggggccgcgggttttcatgtacccagcatgagctcctacttcgtcaaccccctgttctccaaatacaaagccggcgagtccctggaaccggcctattacgactgccggttccctcagagcgtgggcaggagccatgcgctggtgtacgggcccggcggctcggcgcccggcttccagcacgcttcgcaccacgttcaagacttcttccaccacggcacctccggcatctccaactcaggctaccagcagaacccgtgctcgcttagctgccacggagacgcctccaaattctatggctacgaggcgctccccagacagtccctttatggggctcagcaagaggcgagcgtggtgcaatatcccgactgtaaatcctccgccaacactaacagtagcgaaggacaaggccacttaaatcaaaactcgtctcccagcctcatgtttccatggatgagaccccacgctccggggaggcgcagtggacggcaaacttacagccggtatcagaccttggaactagaaaaggagtttctctttaatccttatttgacacgaaaacgtcggattgaagtctctcatgccctgggactgaccgagagacaagtgaagatctggttccagaaccgaaggatgaagtggaaaaaggagaacaacaaggataaactgccgggagcccgagatgaggagaaggtggaggaagaaggaaatgaggaagaggagaaagaagaggaggaaaaggaagaaaacaaggactaagcaaaaaagaaagacccccccccccttagcaactcccttgaagtttcgttttatggtagcagataaattgagaagtttacgactgtcatttgcttttatagagaatagaatgacactcacaactctaactacctgtcagatacttgcagctctggttttattacctttggacttcccccactctttatttgtttgggggctggaggggggagacggagaaacagtgaaaagttcggactctctgtctcactccttgccccacacacacttgtccctgcccccacccttctgagtccttcctggattttaaggtctgagacctggcctccgtgctcctcggtctgtctctcaccacactcccacctccctgcttctctggtatttattttagaggggagccccctcgaaatgcagaaaaggacttgtggttttgtttttatgctaaggctagtgtactagatgtactttttctaaaaaggaaaggacagaaaaaaatgaagaaaggaaaggaagacaaatgtaaagaaataaggaaaaaagcaaggaatatcccctccccctccccctccccctccccagggctccctgcttagaaaaacccccttgactttctctaggaacctgatggaaacctgaaggagatgtgggtctttcccctccccccatttccagaagggtagataggagcctgcagtcgcctctaaaatcctacctaaccatcccatggtcactcgggcccatgccttcctctccttcgctgtttgatttctattctgttgggcccgccttcctctgagctgcattagtgttagtgctcagaaatcaccataatcacgaaaataataataataaatctttaacatactacctaaagggaacctgcaataatcttgaaaaagaaaaagagaaaaattttaaaatcctgctataggagaaaaaaagagaaaaaaataaaaatcaaaaaaaaaaaaaagaaagaaagaaacctccagcgtattttatcactacctatagaaagaaatcctgctttgagagtatttgtaatgcggttttgttgtcgtttgttgctgcttatttcactaagaaaacccaacaactgagactgcctagcccgccggtcctgtgcgcttttattgtgcttctaaccccagtagagtagaactaaattgcactgaatgtatagttaactctgtcttgaattctctgtttatgcaatgtgctcgaaagaaaaaaatgttaaaaatatatctataataataattttttgtcatttgtctttatgtccagctatgaatgtagattttgtgtcccgacagccctgttcctggtccaagtactttgtattgtatacgtgagtcataataataaaaagaagaagaaaa

SEQ ID NO: 416 - DNA, 1640 bp, Homo sapiens
tggaaaaataattacctgacttgattgttctgtgagcagataaaaagtacatatacagttcatacaataatcttatgtatgtaaaaccccgttacgatgtcggcgacggggcccatcagtaactattacgtggactcgctcatctctcacgacaatgaagacctcctagcgtccaggtttccggccaccggggctcatcccgccgccgccagacccagcggtttggtgccggactgtagcgattttccgtcctgtagcttcgcgcccaagccggcagtgttcagcacgtcgtgggcgcccgtgccctctcagtcgtccgtggtatatcacccgtacggcccccagccccacctcggcgccgacacgcgctacatgcggacttggctcgagccgctgtccggcgccgtctccttccccagcttcccggccgggggccgtcactacgccctcaagccggacgcctaccccgggcgccgcgcggactgcggcccaggggagggccgcagctacccggactacatgtacggctcgcccggggagctgcgcgaccgcgccccgcagacactgccctcgcccgaggcggacgcgctcgccggcagcaagcacaaagaggagaaggccgacctggaccccagcaaccccgtggccaactggattcacgcccgctccacgaggaagaagcgctgcccctacaccaagtaccagacgctggaactggagaaggagtttctcttcaatatgtatttaaccagggaccgtcggtatgaggtggcccgggttctcaatctcaccgagcggcaggtcaaaatctggtttcagaatcgaaggatgaagatgaaaaagatgaataaagagaaaaccgacaaggagcagtcctaaaccctacccagcctgctgcctcagcacagccaagggaaaaacaaaaaccccacaaaataccccaacacaggcgggggagagacgaaaaagaaaaggaaagagcaagatagacaaaagccaatcagcttaaaaagaaaaacaaggaaggggaaaagaaaactcttgcgatttgggagggttcagtgttgagatattggtgttttagagttagttctacccagcgaggaggaggcggggagagaaactgcgttctctttccccagcgcaaccgaaataaatgacacatacaaatgtgatttttttcctcctttcttcagagaagccagtacttgaatcgctatatttctatttttttttccctgtatcgtatttggtccaggtcatccctccccgggcctggggcgctctgcgtgcagattttgtacaaaaaaaaaaaagacacacacacatacatgataatgattcccagcccaggagctgaggggtgagggctggggaccatgccgcgggctaggtcgggcccgtgcaggccggcgccttgggctgtacatagtgttccctctcatccccagggttcgtccccagcgtccgtcctgtaacgtgcttctgtttgttatggtagaacagccctgtgttaatatattgaagtcacttaaccagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 417 - DNA, 1991 bp, Homo sapiens
gccgagcggagaggccgcccattggccggccagcgccacgtggccgcccccgccggtatattaggccactatttacctccggctcactcgccatgggttggagagggcagctcgggtagagagggctggcggagcggcgcagacggcggcagtcctgctcagcctctgcccggctccgtactccggccccggcctgcgccctcagaaaggtggggcccgaaccatgagctcctacctggagtacgtgtcatgcagcagcagcggcggggtcggcggcgacgtgctcagcttggcacccaagttctgccgctccgacgcccggcccgtggctctgcagcccgccttccctctgggcaacggcgacggcgccttcgtcagctgtctgcccctggccgccgcccgaccctcgccttcgcccccggccgcccccgcgcggccgtccgtaccgcctccggccgcgccccagtacgcgcagtgcaccctggagggggcctacgaacctggtgccgcacctgccgcggcagctgggggcgcggactacggcttcctggggtccgggccggcgtacgacttcccgggcgtgctggggcgggcggccgacgacggcgggtctcacgtccactacgccacctcggccgtcttctcgggcggcggctctttcctcctcagcggccaggtggattacgcggccttcggcgaacccggcccttttccggcttgtctcaaagcgtcagccgacggccaccctggtgctttccagaccgcatccccggccccaggcacctaccccaagtccgtctctcccgcctccggcctccctgccgccttcagcacgttcgagtggatgaaagtgaagaggaatgcctctaagaaaggtaaactcgccgagtatggggccgctagcccctccagcgcgatccgcacgaatttcagcaccaagcaactgacagaactggaaaaagagtttcatttcaataagtacttaactcgagcccggcgcatcgagatagccaactgcttgcacctgaatgacacgcaagtcaaaatctggttccagaaccgcaggatgaaacagaagaaaagggaacgagaagggcttctggccacggccattcctgtggctcccctccaacttcccctctctggaacaacccccactaagtttatcaagaaccccggcagcccttctcagtcccaagagccttcgtgaggccggtacttggggccgaaaaactgtggcctgcagaagtcccaggcgacccccatccctatctagacttaggagctcagtttgggatggaggtgggagaacaaaaatgaatagggatttcacttgggaaatgaagtactttagttggcttccgagttccagactatatgtccagatattaattgactgtcttgtaagccacttgtttggttatgatttgtgtcttatcagggaaaaggtgcccagctgccagcccagctccgctgctatctttgcctcacttagtcatgtgcaattcgcgttgcagagtggcagaccattagttgctgagttctgtcagcactctgatgtgctcagaagagcacctgcccaaagtttttctggttttaatttaaaggacaaggctacatatattcagctttttgagatgaccaaagctagttagggtctccttgatgtagctaagctgcttcagtgatcttcacatttgcactccagtttttttttctttaaaaaagcggtttctacctctctatgtgcctgagtgatgatacaatcgctgtttagttactagatgaacaaatccacagaatgggtaaagagtagaatctgaactatatcttgacaaatattattcaaacttgaatgtaaatatatacagtatgtatattttttaaaaagatttgcttgcaatgaccttataagtgacatttaatgtcatagcatgtaaagggttttttttgtaataaaaattatagaatctgcaaaaaaaaaaaaaaaa

SEQ ID NO: 418 - DNA, 1814 bp, Homo sapiens
cggggaatgttttcctagagatgtcagcctacaaaggacacaatctctcttcttcaaattcttccccaaaatgtcctttcccaacagctctcctgctgctaatacttttttagtagattccttgatcagtgcctgcaggagtgacagtttttattccagcagcgccagcatgtacatgccaccacctagcgcagacatggggacctatggaatgcaaacctgtggactgctcccgtctctggccaaaagagaagtgaaccaccaaaatatgggtatgaatgtgcatccttatatacctcaagtagacagttggacagatccgaacagatcttgtcgaatagagcaacctgttacacagcaagtccccacttgctccttcaccaccaacattaaggaagaatccaattgctgcatgtattctgataagcgcaacaaactcatttcggccgaggtcccttcgtaccagaggctggtccctgagtcttgtcccgttgagaaccctgaggttcccgtccctggatattttagactgagtcagacctacgccaccgggaaaacccaagagtacaataatagccccgaaggcagctccactgtcatgctccagctcaaccctcgtggcgcggccaagccgcagctctccgctgcccagctgcagatggaaaagaagatgaacgagcccgtgagcggccaggagcccaccaaagtctcccaggtggagagccccgaggccaaaggcggccttcccgaagagaggagctgcctggctgaggtctccgtgtccagtcccgaagtgcaggagaaggaaagcaaagaggaaatcaagtctgatacaccaaccagcaattggctcactgcaaagagtggcagaaagaagaggtgcccttacactaagcaccaaacgctggaattagaaaaagagttcttgttcaatatgtacctcacccgcgagcgccgcctagagatcagtaagagcgttaacctcaccgacaggcaggtcaagatttggtttcaaaaccgccgaatgaaactcaagaagatgagccgagagaaccggatccgagaactgaccgccaacctcacgttttcttaggtctgaggccggtctgaggccggtcagaggccaggattggagagggggcaccgcgttccagggcccagtgctggaggactgggaaagcggaaacaaaaccttcaccgctctttgtttgttgttttgttgtattttgttttcctgctagaatgtgactttggggtcattatgttcgtgctgcaagtgatctgtaatccctatgagtatatatatatatatatatatatatatataaaaacttagcacgtgtaatttattattttttcatcgtaatgcagggtaactattattgcgcattttcatttgggtcttaacttattggaactgtagagcatccatccatccatccatccagcaatgtgactttttcatgtctttcctaacacaaaaggtctatgtgtgtggttagtccatgaactcatggcattttgaatacatccagtactttaaaaatgacatatatatttaaaaaaaaaagattaagaaaacccacaagttggagggagggggacttaaaaagcacattacaatgtatcttttcacaaatgaatttagcagttgtccttggtgagatgggatattggcgatttatgccttgtagcctttcccttgtggtgcatctgtggtttggtagaagtacaacagcaacctgtcctttctgtgcatgttctggtcgcatgtataatgcaataaactctggaaatgagttcaaaaaaaaaaa

SEQ ID NO: 419 - DNA, 1463 bp, Homo sapiens
atgaacgactttgacgagtgcggccagagcgcagccagcatgtacctgccgggctgcgcctactatgtggccccgtctgacttcgctagcaagccttcgttcctttcccaaccgtcgtcctgccagatgactttcccctactcttccaacctggctccgcacgtccagcccgtgcgcgaagtggccttccgcgactacggcctggagcgcgccaagtggccgtaccgcggcggcggcggcggcggcagcgcggggggcggcagcagcgggggcggccccggcgggggcggcggcggcgcggggggctacgctccctactacgcggcggcggcggcggcggctgcggcggccgcggcggccgaggaggcggccatgcaacgcgagcttctcccgcccgcgggccgccggccggacgtgctcttcaaggcgcctgagccggtgtgcgctgcgccggggccgccgcacggccccgcgggcgccgcctccaacttctacagcgcggtgggccgcaatggcatcttgccacagggcttcgaccagttctacgaggcagcgcccgggcccccgttcgccgggccgcagcccccgccgccacccgcgccgccacagcccgagggcgcagccgacaagggcgaccccaggaccggggctggtggcggcgggggcagtccctgcaccaaggcgacccctggctcggagcccaagggggcagcagaaggcagcggtggcgacggcgagggccccccgggagaggcgggggccgagaagagcagcagcgcagttgccccccagcggtcccggaaaaagcgctgtccctataccaagtaccagatccgcgaactggaacgcgagtttttctttaacgtgtacataaacaaagagaaaagacttcaactctctcggatgctcaacctcactgaccggcaagtcaaaatctggttccagaatcgcaggatgaaagaaaagaaactgaacagagaccgtctgcagtatttcactggaaaccccttattttgagagctccaggaagcgccctcaccccagccccactcacccaccctccttcccaccagcctgctctccgcaggcccactgtccttgggtttaatgacgtctcttctctgtggaacttcacgattccttcccacggtcaactcgggacctcccagcgaccactgcagcctgcggacgaggccgggacttggccgagcggatcctaataaggggaaaatggtaaatgcaaacgtcccgttacaattttaccgccagtgtgctgtcgttccccctccccctctccgagtcctcgtggggacacggcggggtctgtaggaagttgggccgggttgggggttgctagaaggcgctggtgttttgctctgagttttaagagatcccttccttcctcttcggtgaatgcaggttatttaaactttgggaaatgtacttttagtctgtcatatcaa

SEQ ID NO: 420 - DNA, 813 bp, Homo sapiens
atgtgtgagcgcagtctctacagagcgggctatgtgggctcgcttctgaatctgcagtcgccagactctttctacttctccaacctgaggccgaatggcggccagttggccgcgcttccccctatctcctacccgcgcggcgcgctgccctgggccgccacgcccgcctcctgcgcccccgcgcagcctgcgggcgccactgccttcggcggcttctcgcagccctacctggctggctccgggcctctcggcctgcagcccccaacagccaaagacggacccgaagagcaggctaagttctatgcgcccgaagcggccgctgggccagaggagcgcggtcgtacccggccgtccttcgcccccgagtctagcctggctcctgcagtggctgctctcaaagcggccaagtatgactacgctggtgtgggtcgtgccacgccgggctccacgaccctgctccagggggctccctgcgcccctggcttcaaggacgacaccaagggcccgctcaacttgaacatgacagtgcaggcggcgggcgttgcctcttgcctgcgaccttcactgcccgacggcctgccgtggggggcggccccggggagggcccgcaagaagcggaaaccctacacgaagcagcagattgcggagttggagaacgaattcctcgtcaacgaattcatcaacaggcagaaacgcaaggaattgtccaataggctgaacctcagcgaccagcaagtcaaaatctggttccagaacaggcgtatgaagaagaagcgcgtggtgcttcgggagcaggcgctggcgctctactag

SEQ ID NO: 421 - DNA, 2341 bp, Homo sapiens
gagaaaggagaggagggaggaggcgcgccgcgccatggtgtcctgcgcggggccagggccagggccggggccgggccaggccgggccatgagccgcgccgggagctgggacatggacgggctgcgggcagacggcgggggcgccggtggcgccccggcctcttcctcctcctcatcggtggcggcggcggcggcgtcaggccagtgccgcggctttctctccgcgcctgtgttcgccgggacgcattcggggcgggcggcggcggcggcagcggcggctgcggcggcggcggcggcagcctccggctttgcgtaccccgggacctctgagcgcacgggctcttcctcgtcgtcgtcctcttctgccgttgtagcggcgcgcccggaggctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacatggacgtgtcaggcctggcgagcagcagcgtaccggccaacgaggtgccagcgcgagccaaggaggtatccttctaccagggctatacgagcccttaccagcacgtgcccggctatatcgacatggtgtccactttcggctccggggagcctcggcacgaggcctacatctccatggaggggtaccagtcctggacgctggctaacgggtggaacagccaggtgtactgcaccaaggaccagccacaggggtcccacttttggaaatcttcctttccaggggatgtggctctaaatcagccggacatgtgcgtctaccgaagagggaggaagaagagagtgccttacaccaaactgcagcttaaagaactggagaacgagtatgccattaacaaattcattaacaaggacaagcggcggcgtatctcggctgctacgaacctatctgagagacaagtgaccatttggtttcagaaccgaagagtgaaggacaagaaaattgtctccaagctcaaagatactgtctcctgatgtggtccaggttggccacagacagcttagaagccattcggttgtctccaaaaggcctttggaaagacttgaatatgtatttaattccccccaccccctgccaatggtggcaaattttgtgaattgtttttctctcttccccttatctggctctaaaaccttctgctgcccaacctgactttgtagttctgatttttacttgtttattattggttttgttcttgcctagggtttttaaaatatctgtttttaatgttttgtttctccctccaggccagtataaagggacttgaagtattttttaataatccgccccccaatgaacttcagaagtgccattctgatttaagggtttttttaaaaaattactttatttgttcattcccagcactgattatcttcataatccattaggacagaatggttttcagtcgttcatatcctgtaattaggtaattgaatcattagctctcagcagttgccctgaggcaagtggaaaggcaggcagtgctctggggtcaccgagaaagtctaaaaacaggaggctgaaggtactgtgatggctttaaaaatggccaccttattaaatagggattgtatcaatattgaaatgaagacaatctttccaactttgggtgtttcacttgctgttttaattgtttgtttttaacactttgtaggtttgtgttttcataatctttaatttgaaactcatgtgtcctcatggatcgtggatgccttcatttcttgagctctcaatgcagacatttaaatggctgcaatcagtagagtgacccgcggatggcataaatgcacctccttttcttggccttggatctatgggtctgggattgtggtcatctcctcaatcctcaaaaagaggctgaatcaatgtggccgtgggtgggaacttacatacagaacccaatgaagaacttgactgtctaaacaagggggcctcgcatggagctgtaaagcatctaacaaatatgaaaaatgtgaagttccaaggtccaagaagaaaaataatgatgtttctgaaagtgatgataaataattacttttaaagtgctgcatatttatacaattgagagattatttttgtaaatgcaatgtctgtgagctgggatacatgggcagtgcttcagacatttaaaaatcactttttactcctagggagatgccaataaacagaactcttttgtttcaaaaaaaaaaaaaa

SEQ ID NO: 422 - DNA, 2319 bp, Homo sapiens
gcctccacagatatcaaaagaaacctgaagagcctacaaaaaaaaaagagataaagacaaaattcaagaaaacacacacatacataattgtggtcacctggagcctgggggccggcccagctctctcaggattcagcagacattggaggtggcagtgaaggatacagtggtagtcaatgttatttgagcagggtcagcaggccctggagcttcctgagtgcacaatgcagaaggctgcttactatgaaaacccaggactgtttggaggctatggctacagcaaaactacggacacttacggctacagcaccccccaccagccctacccaccccctgctgctgccagctccctggacactgactatccaggttctgcctgctccatccagagctctgcccctctgagagccccagcccacaaaggagctgaactcaatggcagctgcatgcggccgggcactgggaacagccagggtgggggtggtggcagccagcctcctggtctgaactcagagcagcagccaccacaaccccctcctccaccaccgaccctgcccccatcttcacccaccaatcctggaggtggagtgcctgccaagaagcccaaaggtgggcccaatgcttctagctcctcagccaccatcagcaagcagatcttcccctggatgaaagagtctcgacagaactccaagcagaagaacagctgtgccactgcaggagagagctgcgaggacaagagcccgccaggcccagcatccaagcgggtacgcacggcatacacgagcgcgcagctggtggaattggaaaaggaattccacttcaaccgctacttgtgccggccgcgccgcgtggagatggccaacctgctgaatctcacggaacgccagatcaagatctggttccagaaccggcgcatgaagtacaagaaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacttgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtagcggccgccgccagcccgaactcgcggcaaaattacctctcttgctgtagtggtggggtagagggtggggcccgcggggcagttcgggaacccccttccccgctcttgccctgccgccgcctcccgggtctcaggcctccagcggcggaggcgcaggcgaccgggcctcccctccatgggcgtcctttgggtgactcgccataaatcagccgcaaggatccttccctgtaaatttgacagtgccacatactgcggaccaagggactccaatctggtaatggtgtcccaaaggtaagtctgagacccatcagcggcgcgccctgcagagggaccagagcttggagagtcttgggcctggcccgcgtctagcttagtttcagagaccttaatttatattctccttcctgtgccgtaaggattgcatcggactaaactatctgtatttattatttgaagcgagtcatttcgttccctgattatttatccttgtctgaatgtatttatgtgtatatttgtagatttatccagccgagcttaggaattcgcttccaggccgtgggggccacatttcacctccttagtccccctggtctgaactagttgagagagtagttttgaacagtcgtaaccgtggctggtgtttgtagttgacataaaggattaagaccgcaaattgtccttcatgggtagagtcaggaagcccggtggcgtggcacaacacactttggtcatttctcaaaaaccacagtcctcaccacagtttattgatttcaaattgtctggtactattggaacaaatatttagaataaaaaaatttcccagtcaaaaaaaaaaaaaaaaaaaa

SEQ ID NO: 423 - DNA, 1298 bp, Homo sapiens
cattaatatctggcaggggctctcaaatgtgccatagcaagctacttgattacacgtatgttatttagttaaatttgtgaaaattatgagatgctcaccaacccggtgataaacttgctccctcgccattggctggcctggtcacatggctgcccaactttattcagttgacagcaagtaggagggccctatggaaggagaaaaaaagacaacacgagaaaaattagtattttctaccttctgaaattaatggtcatgagttcgtatatggtgaactccaagtatgtggaccccaagttccctccgtgcgaggagtatttgcagggcggctacctaggcgagcagggcgccgactactacggcggcggcgcgcagggcgcagacttccagcccccggggctctacccacggcccgacttcggtgagcagcctttcggaggcagcggccccgggcctggctcggcgctgcctgcgcggggtcacggacaagagccaggcggccccggcggtcactacgccgctccaggagagccttgcccagctcccccggcgcctccgccggcgcccctgcctggcgcccgggcctacagtcagtccgaccccaagcagccgccctccgggacggcactcaagcagccggccgtggtctacccctggatgaagaaggtgcacgtgaattcggtgaaccccaactacaccggtggggaacccaagcggtcccgaacggcctacacccggcagcaagtcctagaactggaaaaagaatttcattttaacaggtatctgacaaggcgccgtcggattgaaatcgctcacaccctgtgtctgtcggagcgccagatcaagatctggttccagaaccggaggatgaagtggaaaaaagatcataagctgcccaacactaaaggcaggtcatcgtcctcatcttcctcctcatcttgctcctcctcagtcgcccccagccagcatttacagccgatggccaaagaccaccacacggacctgacgaccttatagaagtggggaccctgggcccatctctccctgcgcaccaggctgagccgaagctgcgggggcaggccgggcctgctgtcacctcgctgggctctaaggtactgtggggtggacctgggacaagcaggccgccctcggactaggttagcatcctgcccgagggcagccccctccctagagcgggatggggatgggagggggggcgggattctctctctaagtatattatatggcaggagctactgagaacataaaatcttggcgagtcattaaacttatgaaaa

SEQ ID NO: 424 - DNA, 1879 bp, Homo sapiens
tgctgtggtgcgaaaatgcctcgccggtgcgcaccgggtcggcagcctcggcggcgggggcgagattggcgggaggggggcgcggggggggcgcggtaagaggtggcggcgggcagagggtgttttttttcttttccctccagagccggggtttgtaaaccgaggccagagtgtccccgtgggccgagcgcacttttttcttgtccgggtgcgctcagtcactggtgcctgagaggaaacagtggaggcagcggggcaggtcgcctggggcgtcggcgattatattgcggccgagccggggcgcgccgggaaaggccgggagggcggcggcgcgcgggggctgggcgaggccccgcgacccgcgagggaggcggcgcgaagccgaggcggcgggcgcaagagccgggcatgagcgcccagtagctgagcgcccgcggctgcctggcctcagaagcgacgcgcgagcgcgggcgggcggcagcagcgacgtagcccggcggtcccggcggcgagagcagccgccccacaggcccccgcggcagtgcggccgagtcgaggctcgctctctggctgcttagcgccgcccgcccgcccggggccgccgccgctgacgccccaatgagttcgtacttcgtgaacccgctgtactccaagtacaaggcggcggctgcggcggcggcggcggcgggcgaggccatcaatcccacttactacgactgtcacttcgcgcccgaggtcggcggccgtcacgccgccgccgcagcagccctgcagctctatggcaacagcgccgccggcttcccgcacgcgcccccgcaggcgcacgcgcacccgcacccgtccccgccgccctccgggactgggtgcggcggtagggaaggccggggccaggagtacttccaccccggcgggggcagcccggccgctgcctaccaggccgccccccctcctcctccgcatcctccgcctccgccgccacctcccccctgcggcgggattgcctgtcacggggagcccgcgaagttttacggatacgataacttacagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccacaagcagctcctggtagacgaagaggaagacaaacctacagtcgcttccaaactctagagttggaaaaggaatttctttttaacccctatctgaccaggaaaagaagaatcgaggtttcccacgccctagccctcaccgagagacaggtaaaaatctggttccagaacaggagaatgaaatggaaaaaggaaaacaacaaggacaaatttcccgtttcccggcaggaggtgaaggacggggaaacgaaaaaggaagcccaagagctggaggaagacagagccgaaggcctgacaaattaacttctacctttaaaatttaccacagactattaaaactaataatcaccatatgctgtggacaccacctattttctttgttggaaaggaccttacctgtgtttcaagctaccttcatgtcactgctcttgaggttttctgtgctttgagagggatttgggtgtttaaaaaagtttctagtatcacatagaagctgtccttgagctgtcctatggaagggtaatttgatactgaccttgtagctatatttttataatggtttttaatgtctgagctagtgatttgcctcaacaacgtaaacttcctaatgattagcacttaataattgcatataaaatgctttattaattaaacaagtgcacttgaacattttaatatttgtggtgagtaa

SEQ ID NO: 425 - DNA, 1902 bp, Homo sapiens
cgcgaccaatggtggaggctgcagcctgcgaactagtcggtggctcgggcgccggcggggagctgctcggcggcggacagtgtaatgttgggtgggagtgcgggacgcctcaaaatgtcttccagtggcaccctcagcaactactacgtggactcgcttataggccatgagggcgacgaggtgttcgcggcgcgcttcgggccgccggggccaggcgcgcagggccggcctgcaggtgtggctgatggcccggccgccaccgccgccgagttcgcctcgtgtagttttgcccccagatcggccgtgttctctgcctcgtggtccgcggtgccctcccagcccccggcagcggcggcgatgagcggcctctaccacccgtacgttcccccgccgcccctggccgcctctgcctccgagcccggccgctacgtgcgctcctggatggagccgctgcccggcttcccgggcggtgcgggcggtggcggtggtggtggaggcggcggtccgggccgcggtcccagccctggccccagcggcccagccaacgggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcagcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaaacaaccccgccgcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttctttttttttttctttttagatagaagtgactgtgtggttggtctctgaggtatttgggggactctgtatttgctcgtttacgtgttggaaaaaccaagtggctttggggtttcgccctatcccactccctctctttcctgctccattggttccttaagaaatgctatattttgtgagtgcaagctggcttggggagccctctcttgtgtaaatgtcccccatgtttctgaaaagtgctgtagtttagtcccctcacccccagcactgcccaaacaggggccaagtgcgccccaattccaagaatgaaggcagagcgacaacagtgcggacaccccggctgctagcccacggtgaagcccggcggggttgcccaccagttgcgaaagccccctttcctcagggagcacgcgggacctcggtggagatctccagtgaggcttagaggagcccagggcctcgggcgggttggggtttgtcctcagtgcattggacgcgctgctctctcccctgaaggctgggctcgcgtgggcggccgcgggtggtggccctcccggttcctgcccgaggaccagttgtaaatgttactgcttcctactaataaatgctgacctgatcaaatggaaaaaaaaaaaaaaaaaa

SEQ ID NO: 426 - DNA, 1440 bp, Homo sapiens
ggtgtctccgcgtcgctgggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccgcctggagcagaagctcatgtgggccttcagcatgtatgacctggacggcaacggctacatcagccgggaggagatgctggagatcgtgcaggccatttacaagatggtttcgtccgtgatgaagatgccggaggacgagtcgaccccggaaaagaggactgagaaaatcttccgccaaatggacacaaacaacgacggcaagctgtccttggaggagttcatccgcggggccaaaagcgacccgtccatcgtgcgtctgctgcagtgcgaccccagcagcgcctcccagttctgagaggagccaggttccccttcctccctcccttcaccggccccctcccggctcttagcttccactcccttgtgtgtattctggctgggggccagattggggaagcccttctccccgggtctgccctgtggggggcttccggaaaagggaaccctgcggtacccccaggccaaagcaagtaagcggttagcaccccccaatcccagaggcaacaatagagacacaggctgggttggtctgcccctcagtcaggcccccttacccacccaccagccccaaggcccgacccctcccccaaaggggcagtccccttcttgcaggtctcagcttgcggggtggggggagtcatgcccaggggaggagactttttatctggaggggagagaaggattctaggggtgtggagttggagaaagaggcttccttgagccacccttcccaccccagcccttgctggtccctaggccaagccaccaagtgaaaccttccaggatactagcccgccagctgtgggccccagaaagccagcctgccttttagcacttggatacacacagacccacggagctctctgtgtttggcctctcacacacacacaggcccatagacagatgggcagatgcacccagagccccatgcacagtgtcctgcgtgggaaagagacacggtccccctggctgagcccctgtcctcccctctgtccccccaaccgccccccctgcatgcagccaaatggagcatctctgttctttttaataatttcagaataaagtctcatttcagtgcaaaaaaaaaaaaaaaaaaaaaaaaaaaaaaaaaaa

SEQ ID NO: 427 - DNA, 1769 bp, Homo sapiens
cggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccactccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctgaaaaaaaaaaaaaaaaaa

SEQ ID NO: 428 - DNA, 6404 bp, Homo sapiens
gactaatggccctaactaagtattaacccctgccaagaaaagagctacttcctcttgaagtaaatgaagatagtgatgctttctcttaaactttacttataaaaagcatcaaaggggggaatgaagcaggaaatataaaaggaaaaacaagtaaagggaaaacaagtcctttcctgaccagtctgactcactccaaagtcctgctggagctatgataattatctgcaaggccaggcaggggctccgaaggagtgggctccaggagcagggatgagaaaaacaagttctccttatcagtttccctgtttgaaattctctccccataacattattctttgttctgctctcacaactatttttgtaactatttctgcaagtctgtaaagattttgtaagttcttgtttttctttctgtagcatggcaaggtcacaagacatgtttaagtaaggtaggctcatgttgcaaatcctgttgtaaaacctgtcacggtatgattaactgcctttgttctgcttctgtaagactgctttctcacctcgcaggttttgcgccaaaaacccgacttgcccctgcctgatgcatgtataaaagtcaagccctgtctttgttcagggctcagcctttggatgttaatccgctgggccagtggccacctaaataaaaccttcctgttgcacccagtgatctctccggcctcctgattcccacaacatataagcattcctttttctctgcaacctagcccgcatctgtcattgactttttaacaataggcattctgactggatgagatggtatctcactgtggtttttctctgcatttttctaataattaacaacgtgaattttgttttcatatgcttgtcagccacatgtatgtcttcttttgaaaagtatctgttcatgtttttgcttactttttaattaggtttttggttttctttttgttgttgttgttgttttctgagatggagtcttgctgtgtcaccaggatggagtgcagtggcatgatctcgactcactgcaacctccacctcccaggttcagatgattcttctgcttcagtctcctgagtagctgggatcacagggaccattgacatttatggatgtggccatagaattctctttggaggagtggcaatgcctggacactgcacagcagaatttatataggcatgtgatgtgagagaactacagaaacctggttttcttgggtgaaggtattgctgtctctaagccagacctgattacctgtctggagcaaggaaaagagccctggaatatgaagagacatgagatggtagctaaacatttagttatgttttattattttgcccaacacctttggccagagcagaacataagagattctttccagaaagtgaccctaagaagatatagaaaatgtggatatgagaatttacagttaagaaaaggctgtaaaagtgtggttgagtgtaaacagcacaaaggagattatagtggacttaaccaatgtttgaaaactaccttgagcaaaatatttcaatgtaataaatatgtagaagttttccataaaatttcaaattcaaatagacacaagatgagacatactgaaaataaacattttaaatgtaaagaatgtcgcaaaacattttgcatgctttcacacctaactcaacataaaagaatccaaactagagtgaatttctacaaatgtgaagcatatggaagagcctttaactggtcctcaacccttaataaacataagagaattcatactggagaaaaaccttacaaatgtaaagaatgtggcaaagcctttaaccagacctcacaccttattagacataagagaattcatactgaagagaaaccctacaaatgtgaagaatgtggcaaagcctttaaccagtcatcgacccttactacacataatataattcatactggggaaattccctacaaatgtgagaaatgtgttagagcttttaaccaagcctcaaagcttactgaacataagttaattcataccggagagaaacgttatgaatgtgaagaatgcggcaaagcttttaaccgatcctcaaaacttactgaacataagtacattcatactggagagaagctgtacaaatgtgaagaatgtggtaaagcctttaaccagtcctcaacccttactacacataagagaattcatagtggagagaagccctacaaatgtgaagaatgtggcaaagcttttaaacaattttcaaatcttactgaccataaaaaaattcatactggagagaaaccctacaaatgtgaggaatgtggcaaagcttttaaccaactctcaaaccttactagacataaggtaattcatactggagagaaaccctacaaatgtggagaatgtggcaaagcctttaaccagtcctcagcccttaatacacataagataatccatactggagagaatccccacaaatgtagagaatctggcaaagttttccacctatcctcaaaacttagtacatgtaagaaaattcatactggagagaaactctacaaatgtgaagaatgtggcaaagcctttaaccgatcttcaacccttattggacataagagaattcatactggagagaaaccctacaaatgtgaagaatgtggcaaagcttttaaccaatcttcaacacttactacacataagataattcatactgaagagaaacagtacaaatgtgatgaatgtggcaaagcttctacctgatcctcaaaactcattgaacacaagaaaattcatactggagagaaaccttacaagtgtgaagaatgtggcaaaacttctaaccatttctcaacccttactaaacataagatgattcatactggagagaagttacacaaatgtgatgaatgtgacaaagcttttaaccaatcttcaaccctttctacacataaaagaattcatactggagagaaaccctacaaatgtgaagaatgtggcagagcttttaattgatcatcaaaccttattaaacataagaaaattcatattggagagaaaccctacaaatgtgaagaatgtggaaaagcttttaaccagttctcaactcttactacacataaaataattcatactggagagaaaccatataaatgtgaagaatgtggcaaagctttcaacctatacgtaaaccttactacacataagaaaattcatactggagagaaaccctacaagtgtgaagaatgtggcaaagcttttagccaagtgtcaactcttactatacataaaagaattcatactggagagaaaccctacaagtgtgaagaatgtggcaaagcttttaaccaagtgtcaactcttactatacataaaagaattcatactggagagaaaccttacaaatgtgaggaatgtggcaaaactttcagtcgatgctcaaaacttactacacataagaaaattcatacaggagagaaaccttacaaatgtgaaaaatgtgctaaagcttttagccagtcttcaaccctttctacatataagataattcacactggagagaaatgctacaaatgtgaagaatgtggcaaagtttttaaccgatcttcaaaccttacagaccataaaaaaattcatacaggagagaaatcctacaaatgtgaagaatgtgacaaggcctttaacctgtcctcaacgcttactaaacataaggtaattcatactggagagaaactgtacaaatgtaaagaatgtggtaaagcttttaaacagttctcacaccttgctatacataatataattcatactggagagaaactctacaaatgtgaagaatgtggcaaagcttttaacttatcctcaaaccttactgcacataagaaaaatcgtactggagagaaaccctacaaatgtgaagaatgtggcaaagctaacctatcatcaacccttactccacataagacaattcatatttgagagaaaccctgcaaatgtgaagaatgtggcaatgcttgtaactaaatctcaaactttactaaacataagaaaattaatactggaaactttacaaacctgaaagatgtgacaatgattttgacaacaccttcaaacttttctaaacataaaataaatcatactggtgagaaatcttaaaaatatgaagaatggtacaaagcctttaaatggttgtcacacttgattgtaggtaagataatttatactggaggaaactcccagaagtgtgaagaatgtggcaaaacttttaatttttcacaccttatagcacaggaaagcacttcagaaaaattgtacaaatataaatgtggaaaagccattaatatctgcttacatcttactcaacattagagagttagtgcttaataaaagcattataaaagcaattagtgtaaaatcagaaaatgaaagttttttttttttttttagatggagtcttgctctgtcacccaggctggagtgcagtggtgtgatcttggctcactgcaacctctgcctcccaggttcaagcaattctcctgccttagcctccagagtagctgagactacaggcacacaccaccacatttggctaatttttttatttttagtagagactggctatcaccatgttggccaggctgatcttgaactcctgacctcaagtgatccacatgcctctgcctcccaaagtgctgggattataggtgtgagtcactgtgcctgacaaatataagcctttaaagagaagaaggttttcattttgaagacaaacattaggtacataaagagggttgtagtgtctttatttgtatcacagattttattgtacacattatgtactaaaggaaaatcctgaagcagtgctcaaactttgatcaacatcagggagtttatattggagaaaaactgcaaatgtaatatatttggaaaaacatttttcaaaaactactgcttagaaaacaccaggggatttatactaaaatatatttttgcagatgcagtaagtataaaagaaatttaatccaaaattaagtgtgtgtaaatatcagagaattcacagtagaaatatctaaggcactgacattttagacattgaactaatcagtgtgctgagtacagaaaataatccaaaattaaagttggtagataaattatttatatataactttaaaagaggtagaaatatttttagttataattacatttaaagtatacttttttctttgaaaaaattacaaaatttttaaaaagtgaatgatgtaattcaactcaaattacttcatgcttttcattctattgtattcacatgtgaaagcatgtgatcaattgctgcttcatcaaagatatgagacattcttttttgttaggtgggcaatattttttaccttttctatggaagagtaaagacattacaatgtaggatgcatgataaaaatctaagtggagaggctctttgtgtttaatttataatattgaatgatgtatgagggaagtgttcagaggaatattctgcattctagtgaaaatatcttttattttagttaaaattaaattaaaattagtagtatatcattttactaactgtacttttatgtaataaaatgcagcacatttaaaaaattttagattattgtgaacttaattttttaattaaactttttttttaacatgttaagaccaattgtgcattcagtgaagtattatcatgccactaacttcaacctatcccaccttactcaagggtgttggtaaaagatagtaacaatgtactatttaataacagagtggactaacatctctaataatttctcttgccagtgactttaaactaaagaacttaattaaagaacattgttcccataggttaaatttttattctttttcttatttaaacatatttttcttaacttttgtgggtacatagtgtgtgtatatatttatgccatatatggcatattttgatacaggcatatgaataggtattaatcacatcagggcaaatgaaatatccatcaactccagcatttatcatttgtattacaaaccgattctacacttttagttactttaaaatgtacaagtaaattgctattgactatagggtcattttcatgggtataataaaaattatatacaagtataaataaaatcctgagtcttaaaattctgagtcctgcttaaacattttaaaaattttgttatgtatttttctttgaacatgtctctctgcctgcaaacataacagaattttagtattggtttacatagagttaactatacccatatattactctaaaaataaatgttaagtgcaagaaagttatggactgtttttgtgtgagtgtgagtttgtacctattttcaaaagaaaagagcaatattggagcaaaacaaatattttaataaagtaatgtactagacaactgaaaacttc

SEQ ID NO: 429 - DNA, 5709 bp, Homo sapiens
tctcccgggagccactcccctgggcgcctctccagcccctgggctggaagcaccagcaaccctggggatggggcagaccctcacagcccggggtctggagccggtgtcggagctcacatgggcccatgacctctccagacatttggcaaaatcaaggcccttagaccagggacagacccaagcccaggccctcccagaggtcataggacgcaaccctttgtgcccttgggctatggaagaggtttgggaacggctttggggtggaagatggccaaaggagcagcttggccaggtgaggatgaggcagggcagacacaggccagtggggcgtgccatgtgccacagatggagaggaccaggagccagtggcccggcaggcacagcccggttggcgtgggccagagcgcccatcactgacccgtgagaactcgactgcccctgccagctctggcactgccccctcccagccgccccgccctagcaccctggggggcaccccgcccaaccgtggcctggtccggcccctcccgccctttgctccagttcccgggcttggcacctatagtgggggtgccgcccgcctgccaggctccggggccgggcccacgggagggtggggcggctgggaagctggcacgctgccccgggggagcctctgtcggcaggcgcccgggtgccgcgggggggagggggaacaaagggctcattctccccgtgcgcagccggtggcatcgccggggcgttggcggaagcccccggggcccgggagggggccggcccaggcgcggccgccgaatcacgggctcctgtttcccgcagggtgctggaggaggaaaccggcggagcagcttccccactctcagttgcgcgtctggcgatggcgatcagaggtcgtgctgcgctctccgccgcgctctacctccattagccgcgctgcgcggtgctgcgccctcgccggtgcctctctcctgggtcccaggatcggcccccaccatccaggcacgacccccttccccggcccctcggcctttcccccaactcggccatctccgacccggggcgcgtgttccccccggcccggcgccttctctccctccgggggcacccgctccctagccccggcccggccctccccgcggcgcagcacggagtctcggcgtcccatggcgcaacctacggcctcggcccagaagctggtgcggccgatccgcgccgtgtgccgcatcctgcagatcccggagtccgacccctccaacctgcggccctagagcgcccccgccgccccgggggaaggagagcgcgagcgcgctgagcagacagagcgggagaacgcgtcctcgcccgccggccgggaggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtggggatcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggaccctttcccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggctttggcagagctgagcactgcaatgcaccaggtctgggtcaagtttgatatccgggggcactgcccctgccaagctgatgcccgggtatgggcccccggggatgcaggccagcagaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccgggccttgccctgcgtccactggagccccagctctgggcagcctatggtgtgagcccgcaccggggacacctggggaccaagaacctctgtgtggaggtggccgacctggtcagcatcctggtgcatgccgacacaccactgcctgcctggcaccgggcacagaaagacttcctttcaggcctggacggggaggggctctggtctccgggcagccaggtcagcactgtgtggcacgtgttccgggcacaggacgcccagcgcatccgccgctttctccagatggtgtgcccggccggggcaggcgccctggagcctggcgccccaggcagctgctacctggatgcagggctgcggcggcgcctgcgggaggagtggggcgtgagctgctggaccctgctccaggcccccggagaggccgtgctggtgcctgcaggggctccccaccaggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttcatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcatgcccttcccggtccgcccgcttccctccttcatgatttccattaaagtctgttgttttgaaaaaaaaaaaaaaaaaaaaaaaaaa

SEQ ID NO: 430 - DNA, 4753 bp, Homo sapiens
ttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacacagacacacagacacatacgcacacacgtgcacacatgtacacacggatacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccagtcctctcctgaggcttttcccagaggtcatgcccagccctgggcaggggtgagggcagggttgtggctgccaggcacaggtccagcgggctgggagtcctcaccatggctggctgtgctgattatggttgcatggggctgggaagaggtcccatttctgagccacagaaacaggccacatccagtaggggtcctggaaggctgtgagaacccagaggagaccctgacccagcctgcaggtagaagactgcctttggaggcagctttgaaagatgactcttccagatggaagaatcaggaagggccttcccacgtggaggcaccagcaggagcaaacgtccctggtgtgttcaggcaaagagccacaggagagtgacctcgtggagtgggaagagattgtttcccattcccttgccagggattggttgaggaatggacaaggcttgcagttcacgcaagccagtgaaatgcgaggggaagtcttgggagtggggtggaggaggtcatctgggaagggtgtccttggtcttaaaaagaggcacaagaggccgggcgcggtggctcttgcctattatcctagcactttgggaggccaaggcagggggatcacttgaggtcaggagttcgagaccagcctggccaacatggtgaaaccccgtctctactaaaaatacaaaaaattagccagacgtggtgccaagcacctgtaatcccagctactcaggaggctgaggcaggagaatcacttgaacccaggaggcagaagttgcagtgagccaagatcgcgccactgcactccagcctgtgtgacaagggcgaaactccatctcaaaaaaaaagggggagggtggcgcaaggagaggacacctctctcctggccctgtcgccatcttccctcatcaatagctaaaaatggcaaagaagaaagagccaggaccccgtgccatcaaatcctccggccttgtgctgccctgtctcggcactgcttgccttaggagatcaggagtgttcctagccactgggagatgggatgcctgccactggcagctctgccgtccatcctcaccatcccaccgtccccccaagacagctctccatcccatcctctgcctcccttctagcctcaacctaactcagggctcccccgtctcacacctgggttgcaggaacatcctcttcaccaacccccctcccatccctcctcagggctgcctagggcagctacaaaaaccaggccagcctctgaaaggtgctccacatctcattaaaaaccgtgaaatcgcactgccccactatcagaatagctcagaggagaaggtctgccagtaccaagtgctggtggggatacggagaagagcagctcccaggcgctgctggtgcaaatgtgctttgttgcacccacggcaggaaactgaccagcttctcatcaagttaaatacgcatctaccctatggcctagcatttccactcttgcttacacatccaggagaaatgagtccttacatgcacaaaaggatgagtaccgtaatactcacatcagcaaataaacaatacagctgtgtgtcagtagtagaatgaataaattgtggtcgattcataaaaaaaaaaaaaaa

SEQ ID NO: 431 - DNA, 1471 bp, Homo sapiens
atcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagatagctcgcggcattccaagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactgagggggctcaggccacccctcctcctaaactccccaacccacctctcttccctccggactctaaacaggaacttgaatactgggagagaagaggacttttttgattaagtggttactttgtgtttttttaatttctaagaagttactttttgtagagagagctgtattaagtgactgaccatgcactatatttgtatatattttatatgttcatattggattgcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggcaaaaaaaaaaaaaaaaaa

SEQ ID NO: 432 - DNA, 1070 bp, Homo sapiens
aaagacaggtgactagaaatattaaaacaaaaacaaaaaaaaagagagagagagaaaaaggaaagagaaaatacatatttcttccccttactaagctagcgaaaataaaatttaaggcaactgaaatatgcacccaatcaatgtgagacgagaccccagcatccctatctatggactccgacagtccatcttattaaataccaggcttcaggactgctatgtggactcaccggctctcaccaacatctggatggccagaacatgtgcaaagcagaacattaatgccccagcaccagctaccacttcctcttgggaagttgtaaggaacccattaattgccagttccttctccctggttaagcttgtactcaggcggcaactgaagaataagtgctgcccaccaccatgcaagtttggagaaggaaaactctcgaagagattaaagcacaaggacgattcagtgatgaaagccacccagcaggccaggaaaagaaacttcatcagttccaagagcaagcagccagcagggcataggaggcctgcaggaggcatcagagagagtaaagaaagttcaaaggagaaaaaactaacagtccgccaagatcttgaggacagatatgctgaacatgtggctgccacccaagcgctaccccaggacagtgggacagcagcctggaagggccgagtgttgcttcctgaaacccaaaagagacagcagttgtcggaggacacgctaaccatccatggtctccccacagagggttaccaggctctgtaccacgctgtggtggagccaatgctgtggaatccttcagggacccccaagaggtacagcctggagctgggcaaggccattaaacaaaagctctgggaggctctttgcagtcagggtgccatctctgaaggtgctcagagggaccggttccctggcaggaagcagccaggtgtccacgaggagcctgtactcaagaaatggcccaagttaaagagcaaaaaataggaacaagaactcatgggattagagtattctctgctagagatctgaaaaataaacacaactttgcaccttc

SEQ ID NO: 433 - DNA, 6025 bp, Homo sapiens
gtagaggcggaagttgaggggactgacgcagatgggggaattttgcctcgatggcactttcctgtccgcgactccgcccccaccagaggggctaggctctgggattcaagatggaggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccctccgggtcacaggataagtctgctccatctggacacaagcatctgacggtagaagagttatttggaacctctttgccaaaggaacaaccagcagttgtgggtctggattcagaagaaatggagaggttgccaggagatgcctcccagaaagagcccaattcattcctaccatttccctttgagcagttaggaggagcccctcaatcagaaaccctgggtgtcccttctgctgcccaccattcagtccagcctgaaatcaccaccccggtgctaatcactccagcctccatcacacagtccaatgaaaagcatgctccaacctacacaatcccgttgagccctgttctcagtcccactctgccagctgaagctcctactgcacaggttccccccagcttacctcgaaacagcaccatgatgcaggcagtgaagaccacgcctagacagaggtctccactcctgaaccagccagtccctgagctaagccatgccagtctgattgccaaccagagccccttcagggccccattgaacgtgacgaacacagctggcacatccctcccaagcgttgatcttctccagaaactcaggttgaccccacagcatgaccaaatacagacacaaccacttgggaaaggtgcaatggtagccagcttttctccggcagctggtcagctagccacacctgagagcttcatagagcctccctctaagacagcagcagcaagagtggcggcctcagcctccctgagcaacatggtgcttgctccccttcagtctatgcagcagaaccaggatcctgaagtatttgtgcagcctaaggtgttatccagtgccatcccggttgcaggcgccccactggttactgcaacgaccactgcagtgtcttcagtcctgctggccccaagtgttttccagcagacagttacaagatcttcggaccttgagaggaaagccagctccccttctcctctaactattggaacgccagaaagtcagagaaagccttccattattctcagcaagtctcagctccaggatacattaatacatctaataaagaatgattccagcttcctcagtacacttcatgaagtctacttgcaggttctgaccaagaacaaagacaaccacaacctatgactggagcagaataagtctaaaggcagagccccagcctcagagacaaataggcttcatcatggaaacttctgagcagaacattgagtttgagaatcctgaaattgagcctatgagaaagagactcatttcttaagaatgttttccaagtgacattctcagtgataatggaggtttcactgtgaagcatcaccagcagatccttgttttgacaaaaaaaaaaaaaaaaaaaaaaaaaaagagagcgatcattgtgttaagttatgtgggtgttttcatcagctaggagcaaggctgtggaataaggagtcagattctcagcttgctttcactttcaaggacttacagaggagtagtcaccagcctcacagcagaagttcagcccggcccccaccgcttcccccagcctaccccatagaaacgggctttgggctgacaagtcaagttttgaacagagtagaaggcagctctgcaaagtagcttctagtttttaggaccagaatttaagccggcaaattaggaattatttcctcaagtgaagtatattttatatgaatgccccatttgggccttaaaagttgtgaaatttcttaatagcattttgtttttaagtgccccagtcctgccctgcagcaggcccccagtgcagcattaccatttgaatagggcactgtcaggctctggtggtgtggacacaggcatgtcatacctttgaaggaaaggctggggctgggaatgcccacatcctatcaaatcttcattttaggttaaactctccattggttctgaaaatgctaagtttgtgtgtgaagcacagccttattttccttttctgtcattgttgattgttttccttaacactttgacaaaaggaccagtggaccaatctgacaaagccattctggttcctttccttgagtgtactgagaatagttttaaagctatgcagaaaagggagctgttattcacactgcccttattttgttgtagaattatggagttaaaagaaaatgtgattccgaactctaccaatgtattcctaggctgtgagtactttcccggcccaaagtgtgaaaatatgtaaagaagctttgttatgctgctattgatctgccatgatttctatttattcttttatggcatgtaatggtgtttagtaatattttaatgtagattttgatttatttcagcaatagtaattttaagatattctttgaatgaaagtgtcttcgtttctatgatacaggtcattttgtagtatttaaccaattaagatgcactgcttacttttctgagcactatttaatgatggggtaaaaacccaattggctcaaccagctagcataaggattagctgtgaataatgctgacagatatgatggttccttaggaacaatcatttaagctttaatggtaactcaatcataagtccatagattatttttttctagctaaaattttagaaaattacttgtgaattacatacttgttttagtttggtcttagtttttagcataaagaatgattggcttttgttgatctaaacatgcttcctggacagggtttctgcttctcattttagtgtcttctattgctgtctacctaattatgtgtgaattgtgcagaattcagggaagcttataagttttcatgctcaattgtgaatagtttgttttcacagatagtatgtaaattaagcaaccaaaaatgaattccttatgcatcatctgggaacgagaaagctatagtgggatacagagtgttgctgacaccgggagatggtgtccagggagccacgtgacttccataaagtggacgcaccagtaggtgtgattgcacctcaagtgtagtctcagtgggcttcggtgaacagacgaatcaagggattcttgaatcgaaattatgcttttgagtatgtaatattatgagagagttaagagagaatatcctaaagagagtctgtgatcatactaattttcacctttaatgctaggaatggatatgatagacagtaaagagcatctatgataaggcttccttagtgtgaaagtaaacttaagtgcccaagtcatggagacttgaaaagggtaaacctgtttcacctcccaaatttatatattcaaagtatttacttaaaattcagaagccagaagttcatgtcatgattaccaggaagttcaggccagaatgaatccctagagaagccaggccaagcctggataattgcagctggatgaccctggcccgaaagtcacagttcagttgccttattcctagttcaggcttactatctagaacctcatgctagcttaggttgcatgtttacattgctgcagtgtctttactggaagcttagttggatcgaaatggacaccgagatggagatgcttctggctagatttcgcagaaccccaggagacctgcatttagaccactctgtccatttgtgtgcccacccccacccccagggtctaagtgtagactccaagaggagcagcccagagcttggaggagaggtgtgtctggggcaccactggtgggtggtgctgctcttctttttgttgtagttaatgcggtgtcttttaatggactctcaggcctcccagacagccttgttcctttaaggcagaagctcttcttcattgtgtacctcctgggattcatgaggtgtgagatttggcctgcttgactttgaattcaagtttttcaagtgactctcagtgtcagaagaagcatttcatgctgtccacatgtggtatgtccacagctcaccttcaaaggcttagatgtagccatcacagagagtggtattttattaagaacccaagtcccagcctgaccaacatggtgaaaccccatctctactaaaaatacaaaaattagccgggcgtggtggcacgcgcctatactcccagctacttaggaggctgaggcaggagaatcacttgaacccgggaggcagaggttgcagtgagccaagatcacaccactgcactctagcctgggcgacagtgagactccacctcaaaaaaaaaaaaaaaaaaaaaaaaaaaagtcacgctgggcccctctctacagggggacacacaggcttagtttagtatatgtctaaccagattttgcatgtcaagcatttgtccttttcctggcttatgttttcttgtagaaattatataaaccctatcaaatccactactaggtaaatttttaaaccatgcagctttattactctcctcccccaaagaatgtagtttgaaattttctcatttccatagtagaggccctaactgccattgtattactaataatgcaacatgaaattgaaggtgcctaactgctcaaaaaacaaaatcagccatcatactgtaactctgagaggaatgagaggtggcacaggcacgagtgggctcagcccgtgtgagtgaggagaactgaggaatcctagggtgcgcatcctgcatcctggctgcacgtttgctgcagagtatgtttttctttcttgcctcccttcagttttcttcagttgcgttcagtgtatcttctggaaccaatagtgccctgtgttctcaagtctctaaaatgctaagatctgagcaaagtcaagcagcttacactaggcttttttacagctgtgcttgagaacatttccgagtggaccagggccttgaggagcctgtttttcagcaaattcaacagatgtgtgcagtgattccctccgttttgtatttgacaccttcatttaaaatgctaagatgcaatatcattcacttcaaagtggggaaaatgcagaattgtgtttcctttttatctgtgtgattccttaagaaacatgtttttaaaatatgtgttctaaatggttttttattctgtattactgctttggccatgtggctctcatgactttcattgtaccagattctcagctccctgaaacatggggacgagaagctctggaattacagcaagatttttgttccatgagcgcaatactgtatcattaacatttttaatggtatggattttatagcatctgtgtatgtttgcaaatattaagttattacatgttttaaaatgagcgtttttcatcttaaattttatatgtttgcaaatatatttttttaataaaatttcaaaaccaagttttagcacctactaaaaaaaaaaaaaaa

SEQ ID NO: 434 - DNA, 2095 bp, Homo sapiens
ggggcttattaacggtggtatctggtagagcccccataaagtaccaccgtggggaagacaatgggacccgaaaacgagagccccgtggggggggagatgtgggggagagtgtgtgtgttcagcgctagacaaaagagaccgcgatgcagcactttaaatagtcttctcgttgctagaacatgctataacatgctggcgctggtggattggatcgagcaggatttcaagagcacttggcgaaaggctcacgtttccctccgcgggttcctcgatttcgagctggggagacgaaaagaggttgccggggcttttctgggtggggataccagacctgaccccaaaaagccgcggggggggtccaaaaagaacgtggaggtgtatgatgatgacgtaggctctcaggctgcggacagccccgggaaacgcatggccccgaaagggacatttagagataaggacaaatttgaagggctgtttaagctcggggcgctggtggcaaaaaaagccttgaccccagcattttcttgttcccccaacagggggtcgcctctacacgcccattatggggatgaaatcctctacaaggttgaatccgggcccgtcaacatttgcgaggggggcaaaagaggcgtggggatccaccccccagataactacggcgatacccttgatgaaaatcttggccttccccaaaaaattgtgattaaggtgaagccccaaaccgaggaagccaacacttggttaaggcaggatctgaaaaatcataacagtgcaaaggaggccgggggctccgacgagattaaaacctttgtgacaggatgtaaaaaagatgggcatagtgggcgtaaaaatatgaccacacatgacagaaattcaaaaaagtggcaacgggtaaacttgtcccttatggcctccctccagctagattctaggggcggacgcgcggggccccggcgcggagcgcggcgcctgtgcctggtgtgtgaggactatgccagctgttcaaacacctgtgtctggtcctgtgaagcctacaaggtcttctttcgccgaagtcaaagtttcacagatccagcctgtttcacaaacgattgcaacatctctaagaataggtctaagtcttgcccagcttgcctcctccgttgcctgcaccctagcattaatgagatccgaaaagacaagcgagcagcgctgaaagtgcgagacaacgttggtgaagaggtggatatgaccggtcctagctggacctgcctgaagctacttttttcagatggggaaaaagtgatacccagattgggccatgaactcccagggatcaaggggggccggcaggcaaaacagcagtcccaccgaggaagccccatccccaaaaacaggaaaggttggccccccggacatgtcctgtcaaatgacggcggagctggtggcagggtatggaaaaaaaaatcctgtaaaccaattcgccgagaaggccccaagtggtgggatcggctgaatgaatctacacctttgttttgggggtctcgagccaacaagagtttagggaagggaggcaccagggggaggattttcatcaagcacccacacctctttaagtttgcagcagatcctcaggacaagcactggctggctgagcagcatcatatgcgggcaacaggaggaaagatggcgtaccttctcattgaggaagacatcgggcagcatcatggccaggggttcccagttatgcttctcaagattagccatattaggcacatggttgggggagtggctcattgcttgtacgacatgaaagaaaagaagtttgttctgccatcctggaaggttgagaagttggggaaatacgtggagacactacggacagaaaaagagcatcgtgctgctgaagcaagtccccagacctgactttcccggcccggctgaggccatcatggggatgcggtctagttggctcttagcagcatcaagctgtacatgagctagtttgtagtgactcactgcagagccccccagactggcttgtggttctgtttctaaagttattggaataagaagcaattaaacaagtttgtaatttaaaaaaaaaaaaaaaaaa

SEQ ID NO: 435 - DNA, 2166 bp, Homo sapiens
gcggcgggagcgcgcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatgctaaaaaaaaaaaaaaa

SEQ ID NO: 436 - DNA, 2697 bp, Homo sapiens
acttgtccgtcacgtgcggccgcccggcctctcggccttgccgcgcgcctggcggggttgggggggcggggaccaagatctgctgcgcctgcgttgtgggcgttctcggggagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccagaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgatcttttcactagttctgtgcagatgaatcccacagattacatcaataatacaaaatctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagtactagtgtctgttatgtgtcttctttagaggtgacactcacatgaaacaattttttcttctcataggaagcagtagctttaaactgtctgtggttcattattctcaatatgaatcataccaagatatttgtgcctcatctcgaaaatatattgtatattg

SEQ ID NO: 437 - DNA, 1916 bp, Homo sapiens
ggagtgagcgcggcagtggccctggcagctggcggagcggcccagcccgtgtgcacgtggcgccggcgctgcctttcggttgccaaaattcaggctgtagacggcgagataacaagtttaaaaccccggctaagccagaagagccaaagagggacctcgccaaggccactcctcgctctctaggccgagaatactgcgcaaattctgggaggtttgggcctggcggctctccgttcccgacccccggcgtggattcgttcccgcgctttctggcgtgaggggtcagagggcgcgccgacgctcaggcgaacggagcggaggcggcagcggccatgggcgaagcgggcgccgctgaggaggcctgccggcacatgggaactaaagaggaatttgttaaagtcagaaagaaggatctggaacggctgacaactgaagtgatgcaaatacgggacttcttacccagaatactaaatggggaggtgctggagagcttccagaaattaaagattgtagaaaaaaacctggaaaggaaagagcaagaattagagcagctgaaaatggattgtgagcactttaaagcccgcctggaaaccgtgcaggccgacaacataagagagaagaaggagaaactggctcttcgacagcagttgaatgaagcgaagcagcaactcctgcagcaggcagagtattgtacagaaatgggagcagcagcgtgtaccctcttgtggggtgtctccagcagtgaggaagtcgtcaaggccattttgggaggagataaagctttgaagtttttcagcatcactggtcaaacaatggagagttttgtgaagtcgttagacggtgatgtccaggagctggattcggatgaaagtcagtttgttttcgctctggctggaattgtcacgaatgttgctgctatagcatgtggtcgtgaattcttggttaattcaagccgggtgctcttggacaccatattgcagcttctgggagacttgaagccaggacagtgtaccaaactcaaagtgctaatgctgatgtccctatacaatgtaagcatcaatttgaaaggcttgaaatacatcagcgagagtccaggattcatccctttgctgtggtggcttttgagtgatccagatgcagaggtgtgccttcatgtactgaggcttgtccagtctgtggttctggaacctgaagtcttctccaagtcggcctctgagttccggagctccctgcccctgcaacgcatcctggcaatgtccaagagccgcaacccccgcctgcaaaccgcagcccaggagctcctggaagatctccgcactctggagcataatgtgtaggtgtgctcggccaccagggttttggtgaaaatgccggtgtcccttctccccagatccctcatttgatactccaaaaccatcaccatgtaccatgtgttagagttggcaaaatgtgattgactagagatggacatgaattgatatgtatcccacataactttgtcttggaagtgagagtgcttgtaggtggttggttaagcttgccaaaggagaggccatgaaagaacctgtccttctggaaaagtggtccatgtctgtgctggctggaagagggcttgcttagggcagcttcttgctgctcagcagaccatgacctgtaggttcacctataaaacagggaaattgaataaccatctaccccattagtcagcattttcttgagatacatttctttgaaaagcaattcattctctctctagtaattgtaattaatccccccaaaatgcaagtttacttttataaccttttggtgaacctgctatttcggatgacattgggcattttagttctatattttttgtgcctcttttatttttgaataaagaaaatcagaagagttgtaaaaaaaaaaaaaaaaaa

SEQ ID NO: 438 - DNA, 2532 bp, Homo sapiens
agatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacacgccccacccgctcggtcctggacacactgcccccctctcttgcctccacccctctgcggactctgcagctccgcggccccggcgcagggagagggagggcacgggcgcgggccgggcctcaagggacttgcccagcccacaccaggtcgcgcaccggcgatttctcctgtagaacaaagaaggaaatagagggaccgagaggggtgggactcgaacccaagtctcccactcatctcaccccaccccaccccactccaccccaccccacccctccactccactccactccacacatcccatccagccagccttttctgcctgctggtgcctcggccgctgtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgccttctacttacagcctctcccagagacaaatttgggccttagccctcacagggccaggggccccatcatctctgacatcccagaagactctccatcccctgaggggaccaggctttctccctccagtgatggcaggagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttcaaaaaaaaaaaaaaaaaa

SEQ ID NO: 439 - DNA, 1448 bp, Homo sapiens
agataagtgtacatgcttaggccttctgaagcagcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagttaaagttctattataatccaaatttcaagcgtggctatccccaacttttagtaagagtgaagagaagaattggtgttaaaaatgcttcacctatatctactttattcaacgaagatttcaacaagaagcattttagagcaggggctaacatggagaatcataattctgccttagctgctgaagctagtgaagaaagtttattttcagcctctaaaaatttaaatatgcctctaacaagggaatcttctgtcagacagataattgcaaattcatctgtccccattagaagtggtttccctcctccttcaccttcaacctcagttggaccatcagaacaaattgcaacagatcaacatgctattttaaatcagttgaccactattcatatgcactctcatagtacctacatgcaagcaaggggccacattgtgaattttattacaaccacaacttctcaataccacatcatatctcccttacaaaatggttattttgggctgacagtggaaccatctgctgttcccacacgatatcctctggtatcagtcaatgaggctccatatcgtaacatgctaccagcaggcaacccgtggttgcaaatgcctacgatcgctgatagatcagctgcccctcattccaggctagctcttcaaccatcaccactggacaaatatcaccctaattacaactgatctgccattaaaagaggaccagattatgaatgacaacagagactaacatttacattgacaaaaaaccctaaaaatttctgcaattatcttattgaacaataaaattgcatgtttacttctaaaaaaaaaaaaaaaaaaaaaa

SEQ ID NO: 440 - DNA, 2280 bp, Homo sapiens
aaaatgctcccgccgacgcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttcaaaaaaaaaaaaaaaaaaaaaaaaaaaaaaaaaaaaaaaaaaaa

SEQ ID NO: 441 - DNA, 116 bp, Homo sapiens
accacgtcccagctcctcgctctggaggcaagttgctccagaaacagtacctctccattgcagagggtgcggacttctccagctctccgaacctcacggagactcaggtcaaaatc

SEQ ID NO: 442 - DNA, 700 bp, Homo sapiens
tggtcttgatctcctgacctcatgatccacccgctagcctcccaaagtgctgggattacaggtatgagccaccgcaccgggcctgttctatttttctagttaagggaactgaagctcagagaggtgtcaccagcaggtgttcattcccatgccagccttgccccccggcttttcccaggcaggctcctgcgtgcccactggctccagcctggtcctctgtctcttggctgcttcactcctgctctttgtcccgactctggccctgcttacaggggccactacctgctggtgcctccataacaagcgtctggcgttgagacccctggcatggcaggggctttggggtctggtttccacaaggcttagccatggcagaacctcgttttattttaactctttgcccctacaaacaaacagcagtacttgccagaaccattcttgggattcaggagctcgggcgactgccttgcctctggccgcacccaggagggtggggttggatctgtgtagttgccaggcccacacctgccagcagggggctgactggatccatgctttactgtgtttaatgggggtaacaggggtccctacagccctcccagctaaacatttggaacaaaacaccagcccttttgtagtggatgcagaataaaattgttaatccaatcacctacaaaaaaaaaaaaaaaaaaaaaaaaaa

SEQ ID NO: 443 - DNA, 2291 bp, Homo sapiens
cttgacgcacggagcttgtctgcgccggccagcactggcttctctggactttgcacacctccaggagaagaacccagaaaattgatcagttctaaaaaaccatgccccacttgttggtgactttcagggatgtggccattgacttctctcaggaggaatgggaatgcctggaccctgctcagagggacttgtacagggatgtgatgttggagaactacagcaacctgatctcattggacttggaatccagttgtgtgaccaaaaagttatctccagaaaaggaaatttatgaaatggaatcactccagtgggagaatatggggaaacgtatcaaccatcaccttcaatacaatggtcttggagacaatatggagtgcaaaggcaacttagagggtcaagaagcaagtcaggaagggctttacatgtgtgtcaaaattacctgtgaagaaaaggccactgaaagtcattcaacctcttctacttttcatcggataattcctaccaaggaaaaattgtacaaatgtaaggaatgcagacaaggtttcagctacctgtcatgccttattcaacatgaggaaaatcataatatagaaaaatgctctgaagttaagaaacacaggaatacctttagcaaaaagccaagctatattcaacatcagagaattcagactggtgagaaaccttatgagtgtatggaatgtggaaaggcctttggtcgtacttctgatctcattcaacatcagaaaattcatactaatgaaaaaccttatcagtgtaacgcatgtgggaaagcttttattcgtggttcacagctcactgaacatcagagagttcatacaggagagaaaccatatgaatgtaagaaatgtggaaaagcctttagttattgttcacaatatactcttcatcagagaattcatagtggtgaaaaaccctatgaatgtaaggattgtgggaaggcctttattcttggctctcaacttacttaccatcagagaattcatagtggtgagaaaccttatgagtgtaaggaatgtggaaaggcctttattcttggttcacaccttacataccatcagagagttcatactggtgaaaagccttacatatgtaaagaatgtgggaaagcctttttatgtgcctcccaactgaatgaacatcagagaattcatacaggagagaaaccctatgaatgtaaagaatgcgggaagaccttttttcgtggctcacaacttacttaccacctgagagttcattcaggtgagagaccttataaatgcaaagaatgtgggaaagcctttatttctaattctaatcttattcaacatcaaagaattcataccggagagaagccctacaaatgtaaggaatgtggaaaggcctttatttgtggcaaacaacttagtgaacatcagagaattcatacaggtgagaaaccctttgaatgtaaggaatgtggaaaggcctttattcgtgttgcatatcttactcaacatgagaaaattcatggtgagaaacattatgaatgtaaggaatgtgggaagacctttgtacgtgctacacaacttacatatcatcaaagaattcatacaggtgaaaagccctacaaatgtaaggaatgtgacaaggcctttatttatggctcacaacttagtgaacatcagagaattcacagaggtgaaaaaccttatgaatgtaaacagtgtgggaaggcttttattcgtggctcacaccttactgaacatctgagaactcatactggagagaaaccctatgaatgtaaggaatgtgggagggcctttagtcgtggctcagaacttactctgcatcaaaggatccatactggtgagaaaccctatacatgtgtccagtgtggtaaagactttagatgtccttcacaacttactcaacatacaaggcttcataattgagaaagccttgaatgtgattaaatttaagaaaatcttcatctatttcatatctataatgaatgtagaacatcttgcttctgctcagaatctgctcattcttagaaggcctacattaacatggatgcagaataatttcagaaaccccttaaataattccttaacatctctataaacgctagaatataatgctgaattatatcctttattaagcatcatctccatttcaccatatcctaactgaaatcctatatatttcttgtgtgttcttttctatttgtaaaatactgtaattgtattacaatgactaaattataattaaatacatataattccctttcgatagcaaaaaaaaaaaaaaaa

SEQ ID NO: 444 - DNA, 9351 bp, Homo sapiens
aaccgtccccaacggtcgccagcgcgcggctcccgggccccctcgctcctcccctctggcccctccgagcgctgggggtgcttccctccccgcctcctcgcactcccactcgcgggcacgccggtggctgtgccgccatgccccaccacaggctgctcacgggcctaggcgcggcggcccgagataggggcccctgagcctcccgggggaggagagaggcagcgagccgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagtgatttcctagtaccggactacttaaaccaggaacaagaagagacccttgttcaatatgatcttggagaacacggttttgaaagcaactcctctgttcaaatgcctgtcatttcacaggtctcctcaacccagaattgtgaaagcacttttcccttggggtctcttggtgggctggcagaaaaagaggaagaagtgccagagcagccaaagagcagtgcttgtgctgaggcaaccagagatgaccccccaaaatcagagctgtcttctataactattgagtagttttgtgatttggcttcagttttgttttttggaaagtgcctgtgcttggtcttgtacatttaaatttaatttaattttttaaacaaaaaaagccgggtgggagggagggggagattgggaaagaatttccctttttactttctgagccctgaaactgattttatttttcctaactgagagattgcttctgtaagtacacaataacatgatgttgaaacagaaactatgagacttaaggagaactggttgacttaaaacatataccagttccttcttccattgttaaaagtaggctaacaacagatcattagctagagaggaaatcagatgattattgaccttcttgagacaagagggtacatgagaaactaattactaaacagcttgacaaatggcctgagtagatacttactgctgtacacaggatgttgtataatattttgtaaagcctgttgtttttggaagtatttatggtaagctttcttaaaaattattatggtaaatacttctgaaatccggcgtacttttctttaagctttgtcatttctgttatgatttttcatggtgaaattttggtactgagatgggcattctctgtacctttatagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcccatatgacagcgatacattgtccttacatatttatttttagacattgcaaagttattaaaaacagttaactatagtttttacacaacgtaggcaacaatgaagagtatagactgtaagattttcatctatgactcataaatctgggagaaaaaaattattaagactaatgagaaactgaaaaccttaaactaatgaatattatttctgctgctaaaaatatgaaactttctggtctgtagttgaaatttgtatgatcctctagacttgggtatacttttcatctggtgccattaaagcatctctaatattgatcctaaatatttgtaagtccatgagcagtgaactttggaataagtttctgtgtagatacccaaagtttaataattatgagagcacctgatttgatagacagaaaatacagttctttagtcaaaacacaagatctgaattttgttcaggtgctagaccatactaaatgtatatatttttaattatagtgatttgtttcatttttttagattggctaattctgtaattttttccccaaaaacatgtgaagaaaggaaaagtaaattaaattccttagaactgttttaggttaagattctctgtgtctgcccatattctgcagtccttaacttgttttcaactctttacctcactcatgaacttgtttttacccatttgctgccaaacataggtgtgttcccttcaggagaatcagcatatacaggttatgataggctcccaccatttatgcttcttcactgatagggttgcattactttctgcagcagactataatacttcatatagtactgctgtgtctcaactggaaaggtcaggaattttaatgttacgttgtggtctttgaaaactgttaggcctagcaatagataaatctcaaaattaattttaaaatctgtattgacaagaataggtaaaattatgaccaggaatcattgttacccttagttccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcagaataaattgcctttttaaaaccaagcattttgtacaagcttttattttcagttttttaactaccaaataggtgtgatgtactttagaagtaaacaaagatgttcacccatgataatggatgttaaagctcctgcagttgttcttttcgtgtttaaagggtatattctaatagtggaagcatcaaacatgtcagtgatttcatctcattcagaaataaagagattaatattggtctttattttttggcattttaagttttatataaatggatgcagatggagattatcacccacaaatatatttaaatggatttttcttaatttgaatttcaagtaatctttttatttcaagtaattagttacgcatttagttacattgccagttttttttttttatcaatttcagtaagacaaaatatactaaaatgtttaaatagcctcattcaatcttacattttgacatttcagcaatcattctggcttacagtaattagatcccctgttacgacacatgccctttgttcttaataactagcaaaaaaaaaaaaaaaaaaaaactttcatcttgttaaaatactttgccaaatgaaatagactagtcaatacatctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatattaatactaactgggaaaaaaaaactagtgtgaagtttacagttagaagaaacagacccaaagttgccagaaggtaataaataaatgtagttttcactgtaagtaagttattgacgtaagatgctttatttgtaatatatttagattttgaaagttattgagagatgaatgtataaaagctaaattttcttttctgaagcagtgaaacaaaattggggtaacaaggaagctctgttgtggcaaacatgtctatgaggaatattaaaactaagcatactcccacaggctttaaactcaaactatgaacatttaaattaagttgttccttattttgcctatacccatttttatctttcattgtcgtttttgcttgacagtatggtgacagagtatttttatttggaaagtcctcagcaagatgaattagccaaaagcaataatggttcagattaaacaataaagtggaattgattcaatcccaggctcaactaagaacagtcgctctctggatgtttcattttagacgatagataagttgagatgttgtaatatttatggggggttaagcctgtgtcagttatgggatgaagacttgtagtaccagtaccatcagtggtcatacttttttttaactttttactaaactaatacagttagacatttccactctatcgtgattatatttttatgatgggaaaataaaaacacttccatgtttttataaatagtctctgcaaagatttcagatgttattggtatctcggtttggcagtatctgaaaaattgagattgtctttgaaatgtttgtgctacttttacttaagtaaacccccactgtgcaagacccaggccggcttcagctaataccaaggtttctgtgtgcataatagtttacagagaacttaagagtaaggactgcggattaaaaacaaaactttttttaactttaaaatttttagtttttgttcaaagtacctggtttataaagtcaaattcttttattagttcctttctcgtttaaattgactgatgttgctgatgaagcttaaagtcccaggcacggttgtggcgatatactgataaaattggtgcctagtggtgggaggagctccagtgtcaggacttttattaaaaggcccttgttttcccaaatgccaatctagccacatttagatttcattattcaataaaacagatgaaaaatcatcccataaatgaatgttgaggttaccaaagtacatcacctgctgaggaaggataaatcttcctgctttaagggagccctgtcatctctcctcttaatgcacgtttcccttggtattagtggaagctgtgttcaagatgggaagcctttcctgcagttcttagaaacacctgctttctaaggagagccttttctaggattagcttatgtgtgttttctctaggcgattttttatttcagttaccaatttaattttcaagttgacagatgctgtgtaaagtctctcataatgagagtagtccattaaattgttgaaagttgcactgcttttcatctttcaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccatttttaagagtaaatttaatctccaggatttagaagtgtctttccagagaagcataatgagaaagtcagactgaggtaataagaccagaattaagtgatagaagaaactgttgtttggttaaaggacacagatttgaaggaaaaaaattttgatgtaacaattttttaaataaaattttgtttttctgtaatgtcatatttgctgctacagtagctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagttatagcattgtgattctttctgggcactggcattttgtgaaactctcaagggaaggtgatgcaggggagaaaatgtgaattaaattacatagatgggtgtttttatgtcttctacccctttcctagaattagtacaactcttaactgtgccagtccccagttcaccagctttgtatccagtcgtcatctcattcaagtatggctttacttggtgacactggccatagctaagttaacttggcatgtttgacttttgacaataacaaaaatggttttggattttgttttatttccaaaaaatgtatacaatatcagaacttcacattttatatactagtatctggctattagtattttacaggaaccatagttcttggtgactacatatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcagggaaaaactagttttgagtgtctttagatagaaacatgagactaaggtttgattttgttttcgttttctcattaaaatatcttatgctttatggaataaaaaaaaaaaaa

SEQ ID NO: 445 - DNA, 1258 bp, Homo sapiens
ctagaccctcttctctcccttcggcttctctctttcggccggcgccgccagttcctggggcacacccagaggtccccttctcgccgccgcctgcaactgcgagggtagcccggggccgcttggagtcgcccggacctgagaggctgctgcactgggcctcagccagccctccggatgctggtgctgccatccccctgccctcagcctctggcattttcctccgttgagaccatggagggccctccccgtcggacttgccgctccccagaacctggaccttcctcctccatcggatctccccaggcttcatctcctccaaggcccaaccactacctgcttattgacactcagggtgtcccctacacagtgctggtggacgaggagtcacagagggagccaggggccagtggggctccaggccagaaaaagtgctacagctgccccgtgtgctcaagggtcttcgagtacatgtcctaccttcagcgacacagcatcacccactcggaggtaaagcccttcgagtgtgacatctgtgggaaggcattcaagcgcgccagccacttggcacggcaccattccattcacctggcgggtggtgggcggccccacggctgcccgctctgccctcgccgcttccgggatgcgggtgagctggcccagcacagccgggtgcactctggggaacgcccgtttcagtgtccacactgccctcgccgctttatggagcagaacacactgcagaaacacacgcggtggaagcatccatgagccgggctgccgggtgccccaggtaccacaggactttgcagggagcctggactcctgtccagacacctggtgagagcctgaggctggtgttcagggccctggacacagacacagagcagccgcatctcaaaggcagagccctgcctgaaggaggaatccgtgagtaatcttcaggtcctccgtgttctggagctgagatgggaatgagcccctacacagaatggagtcctctagcctaaagatatcagctgttccatggcagagccttgactggatggaggtggggagtgtggtgtgtaaagtctctggcctcataaaaggtggctgtgggtcgtcaggaatctgcgccatcttcctggggcttctgcgctgttgttggggaagggaccccagtcctgccttccaccccccaaccaggcctgagactgatcaaacaataaacacgtttcccactctgaaaaaaaaaaaaaaaaaaaaaaaaaaaaaaaaa

SEQ ID NO: 446 - DNA, 117 bp, Homo sapiens
acctacgagcagctcgtggcgctggagaacaagttcaaggccacgcgctacctgtcggtgtgcgagcgcctcaacctggccgtgtcgctcagcctcaccgagacgcaggtgaagatc

SEQ ID NO: 447 - DNA, 1901 bp, Homo sapiens
gcggcgagtggagcgggagccgactggaagaagggctctagggagggggctgtggctgctggggtccgaggtggggccgggtacaccagccccatcactgtttgcagagagtcagggaggcggaaaagacacgcgctctaggctcccatcagggcacatggcccgggcccatcccccgcgcgtctccccggctgcggggcgcggggggctgccgggtgcgcttggctgtggcgcggcgcgttggagactttattgcgatgggacgataagaggggcgggggcggggtcctgggggccgaggcggcagcgctttaattaaaacggaaattgcggccccgggccgcgcgggggccggagggttccaagcggccccttagctggaagcgtttctccaggacccccccgcaacccccgccacgcccgggctgccccctcccgccaggccctgccggacccggcgccgtcttctcctccttgtcacccgcggtcgcttcgggcggggatcggtgccaccgagcgcaaagcctgcctcgccccccttccccgtcccccccatctcccaccgcccagtccccggcggcgatgagacagagcggcgcctcccagcccctgctgatcaacatgtacctgccagatcccgtcggagacggtctcttcaaggacgggaagaacccgagctgggggccgctgagccccgcggttcagaaaggcagcggacagatccagctgtggcagtttctgctggagctgctggctgaccgcgcgaacgccggctgcatcgcgtgggagggcggtcacggcgagttcaagctcacggacccggacgaggtggcgcggcggtggggcgagcgcaagagcaagcccaacatgaactacgacaagctgagccgcgccctgcgctactactacgacaagaacatcatgagcaaggtgcatggcaagcgctacgcctaccgcttcgacttccagggcctggcgcaggcctgccagccgccgcccgcgcacgctcatgccgccgccgcagctgctgccgccgccgcggccgcccaggacggcgcgctctacaagctgcccgccggcctcgccccgctgcccttccccggcctctccaaactcaacctcatggccgcctcggccggggtcgcgcccgccggcttctcctactggccgggcccgggccccgccgccaccgctgccgccgccaccgccgcgctctaccccagtcccagcttgcagcccccgcccgggcccttcggggccgtggccgcagcctcgcacttggggggccattaccactagacggggcggtcgggtgcctgcggcctcgcccgcacgcctagagtctcgcccgatcccatcggcatcccggggagggcccgggagcctccgtcaaccgtcctctaatccagagtttactccacctgccgcacttagcagggggacgggaccgaagctccctcaatccttgtctggtactagatttgctcctgtcccaccccgcagtcccctgaggagggcgatgtgcgccctctttcactttttttcttctaggtctccaggtcccggaggggatttgtggacctctcttgtctccccaccactccagtgcatttccgcctggctcctagaagccccattcaatatcactactctttaacgagtgccaaatcttttcccacttttgctcttccccaaggaactgctcccacctcagcacgtggaggcctctcacggtcctccttcctgggacctgagcaggtttggtgaaagccaccgtcctccgtgacacacggcccccttcctcctgtccccacactcccaggagaaactcccggtgtgtttctgaccctttcagccccattaaagctcctgagctctcaaaaaaaaaaaaaaaaaaaaaa

SEQ ID NO: 448 - DNA, 1600 bp, Homo sapiens
ggccaaaagttgacttattttgaatggactacattatagcttaactagattgtacgagtgcttatcaactaatatgttaaaatatggtaattccttttttttttttttgagatggagtccagcctgggtgacagagtgagaccctatttcaaaaaaataaaaattggaagaagagcttaaaaaagataagattttaaagagtcccaagttatttaagttgagtgtaattgtcatttaaggaaggcaaatgagtttatcatccttcttaaagagcatctcttttaactgttggacaaaaccataactttgtcattttacaaggaagaacctcttaagaagtcctcagaaccagaagcaatgtgaactctcagcgctggtcctggtgggtttgctgaccatgactgggcaagccgttctttttgctgccatcttcctcatcataaagtgtggaacataggcaattgctttgagattcttggatagaagaggacaacattctgcacctgcccccttttttaaatctttggggaaagatgagtaactttccccactactctgccttcctgttcagtaactcttacttttgcctgaagtaacagcatcttctacttctccatctagagatttttgtgtgtgtgccatcaaggttagcaaactttatacgtagcctaacacttaaaaaatgcactcattatcttaaacctaataaattccagagtttattttggttctcctctgttgcccttcctaaaaaatgagctgaagatgacagtatttttctttacatgcttggttatgacttttaaagttttatttaaataaatgttgaagctcaagtttaaagaagcgttgcagaggcccacggtctcctgggtcccggccacctgtccatattccacatttgctgactgtgctccctgcactccactcaagttgagagttcaaatagtcttgaaggggaatcagcttcaggatggaaggacccaggagaggccccgaggtgggagggttctgtaaatacagactactgcgagtgtccagagctctctgccatgatacttccttgggactgacttggctgagaacgtgttctgtcagaggatttgttagaactctgcccttttgtctgaaactcaaggccaaggagaatgataggagacttaggacagagctgacccttgcaccaggctgggaggctgcagcccttttagatgccacttactgtaagtggccagaataccagagaggtgggttccatggtcaaatgcacagtaggtgtttacctttacatttggatcaccttgtagtctttaaattcttggtccctgaggccaagtccacaacttgccttctagtcacttgcctgcccgcagtggtggtggatgtgttagctggtagatttggaatcagtcaccagtctttctgtactgtcttggttagctctatataagtaggggcagcttagccctgaggcccagagacctgctgtcctttttctccttgagggaggaaataaaactgcggaatacaatgtccttccatagcatgggaagaagaaaataaacatctcctttccaacaaaaaaaaaaaaaaaaaaaaa

SEQ ID NO: 449 - DNA, 993 bp, Homo sapiens
attccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtgaaaaaaaaaa

SEQ ID NO: 450 - DNA, 1402 bp, Homo sapiens
ggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaaaaaaaaaaaaaaaaaaaaaaaaaaaaaaaaaaaaaaaa

SEQ ID NO: 451 - DNA, 1167 bp, Homo sapiens
attctgagccaagtccggtgccaagcgcagctagctcagcaggccgcagcggtggcctgagcttcaggacagccagctccctcccggtctcgccttcctcgcggtcagcatgaaagccttcagtcccgtgaggtccattaggaaaaacagcctgttggaccaccgcctgggcatctcccagagcaaaaccccggtggatgacctgatgagcctgctgtaaaacatgaatgactgctactccaagctcaaggagctggtgcccagcatcccccagaacaagaagtggagcaagatggaaatcctgcagcacgtcatcgactacatcttggacctgcagatcaccctggacttgcatcccactattgtcagcctgcatcaccagagacccgggcagaaccaggcgtccaggacgccgctgaccaccctcaacacggatatcagcatcctgtccttgcaggcttctgaattcccttcggagttaatgtcaaatgacaggaaagcactgtgtggctgaataatcatgacttcttttttttctttgcacaacaacgacaacaacaaattcacagaaccttttcagcgctgaacttatttttcaaccatttcacaaggaggcagttgcatgacttttaaaagcaaaaaaggagaaactagatgaaaaagacttttaaatgccctttctgcagttggaaggtttttttcatatactattcccaccatggggagcagaaacgttaaaatcacaaggaattgcccaatctaagcagactttgccttttttcaaaggtggagtgtcaataccagaaggatccagtatcagtctcttaaatgaagtcttttcggtcagaaattacctttttgacacaagcctactgaatgccgtgtatatatttatatataaatatatcttatttaagtgaaaccttgttaactctttaattagagttttcttgtatagtggcagagatgtctatttctgcattaaaaagtgtaatgatgtacttattcatgatgaactttttataaaagtttaaacttttagttgtaaacgtaacccttttatacaaaataaatcagtgtgtttattgaatggtgattgcctcgtttatttcagaggaccagtgctttgattttttattatgctatgttataactgaaccaaataaa

SEQ ID NO: 452 - DNA, 1288 bp, Homo sapiens
gctaaaggcggactggcagggggcagggaagctcaaagatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcactccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtctcttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatatgatga

SEQ ID NO: 453 - DNA, 2389 bp, Homo sapiens
aggcgcggttgtgagtagtaccgggagtggggtgatcccgggctaggggagcgcggcggccgcgatcgggcttagtcggagctccgaagggagtgactaggacacccgggtgggctacttttcttccggtgcttttgctttttttttcctttgggctcgggctgagtgtcgcccactgagcaaagattccctcgtaaaacccagagcgaccctcccgtcaattgttgggctcgggagtgtcgcggtgccccgagcgcgccgggcgcggaggcaaagggagcggagccggccgcggacggggcccggagcttgcctgcctccctcgctcgccccagcgggttcgctcgcgtagagcgcagggcgcgcgcgatgaaggcggtgagcccggtgcgcccctcgggccgcaaggcgccgtcgggctgcggcggcggggagctggcgctgcgctgcctggccgagcacggccacagcctgggtggctccgcagccgcggcggcggcggcggcggcagcgcgctgtaaggcggccgaggcggcggccgacgagccggcgctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggccggcgcggtgaacaagcagggcgacagcattctgtgccgctgagccgcgctgtccaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtagattgaaatctttgtatttgaagcatacatgttgaaaatacaccttatcagtttttaagtacagggttttatagtgtaatatatacagagtaagtgtttgtttttgtttttcaactgaggtcaaaatggattctgaatgattttgcatatgggatgaggaaatgcttggatccttaaggagtttacgaaatctgctgttttatcaaagtgaaaaaaaattgcttattactcttcattttacactaaagcttaatgtcactaagtttcatgtctgtacagattatttaaatcatggaaatgaaaaaaatgttctctgcttgctaccaaaggacaaactcttggaaatgaacactttctgctttccttcctccaaagaattaataggcaacagtgggagaaaaaaaaggcataatggcaaatccttcaagcagggataaaagtcgatcttcaaacattaacttaagcagaccaaaaattctgatgaccgcatctagattatttttttataaaaatgattttcactatagctatgttacgctaagctactgtcccatctcttgtgatgtgtaacttttacatgtgaatattaaagtagatttctctgtcttgtaaaaaaaaaaaaaaaaaaaaaaaaaaaaaaaaaaaaaaaaaaaaaa

SEQ ID NO: 454 - DNA, 3955 bp, Homo sapiens
gtgcgtaacgcacgggcccggcggggaacaccggtccgctgtaacaccggcccggcgcagaagcgggacgtcggcttctaggggcccaggccggcggcggcgatggcctcggcagctgtggagagcttcgtgaccaagcaactggacctgctggagcttgagagagacgcggaggtggaggagcgcaggtcctggcaggagaacatctctctgaaagagctccagagccgaggcgtgtgtttgctgaagctgcaggtatccagccagcgcactgggctgtacggacggctgctggtcacctttgagcccaggcgatacgggtccgcggcagctcttcccagtaacagctttacttctggtgatatcgtgggcctgtacgatgctgctaatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaaagccctgattgctctaaagaagtatcattctggcccagcctcctcactcatagaagtgctctttggcagatctgctcccagtcctgccagtgaaatacacccgctgacattcttcaacacctgcctggacacctcccagaaagaagcggttttatttgcgctgtctcagaaagaacttgccatcatccatggacctcctggcactgggaaaaccacgactgtggttgagatcattcttcaagctgtgaaacaaggcttaaaggttctgtgctgcgccccctccaacatcgccgtggacaatctggtggagcgcctggctctgtgtaagcagcggattctgcgcctgggacaccctgcccgcctcctggagtccattcagcagcactccctggatgcggttttagcgcggagcgacagtgcccagattgttgcagatatcaggaaggacatcgaccaggtctttgtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgcgtctgccgatggccccctgaagttgctgcccgagagctacttcgacgtggtggtcattgacgagtgtgcccaggccctcgaggcgagctgctggatccccctgctgaaggccagaaagtgcatcctggcgggcgatcacaagcagctgccccccaccacagtctctcacaaggctgcgctggcaggactgtcactcagcctgatggaacgcctggctgaggagtacggcgcgagggtggtgcggacactgacggtgcagtaccgcatgcaccaggctatcatgcgctgggcctcagacaccatgtaccttgggcagctcacagcccactcttccgtggcaaggcacctcctgagggacctcccaggtgtggctgccacagaagagacgggtgtgcccctgctcttggtggacaccgccggctgcgggctgtttgagctggaggaggaggacgaacagtcgaaagggaaccctggcgaagtccgcctcgtcagtttgcacatccaggctctggtggacgctggtgttccagcccgtgacattgctgtggtctcgccatacaacctccaggtggacctgctcagacagagccttgtgcacaggcaccctgagcttgaaatcaagtctgtcgatggcttccaaggccgagagaaggaggccgtgatactgtccttcgtcagatccaacaggaaaggtgaagttggttttcttgctgaggaccggaggatcaacgtggctgtcacccgtgcccgacgccacgtggcggtcatctgtgactcccgtactgtcaacaaccatgcatttttgaagaccctggtggagtatttcacacagcatggggaagtacgcacggcctttgagtatcttgacgatattgtcccagaaaactattcccatgagaactcccagggttccagccacgctgccaccaagccccagggacctgctacgtccaccaggaccggaagccagcggcaggagggaggccaggaggctgcagcacctgccagacagggccggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttccggggaagggaagaggaggttcatcactgtgagcaagagggccccgcgaccccgagcagccctgggacccccagcagggaccggtggcccagcccctctccagccagtgccccctacccctgcgcagacagagcagcctcccagggagcagcgtggcccagaccagcctgatctgaggacgctgcacctggagagactgcagagggtcaggagcgcgcaggggcagcccgccagcaaggagcagcaggcctcagggcagcagaaacttccagaaaagaaaaagaaaaaagccaaaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccccgcggagctctctccatggtagcccagggcgctggcagaccatgctccgcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttccccttactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccagcccctccttgttgcgcctcaccgtggggaccaggtgagccggctctcccacgtggttgtcccgggaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacgttgcacactga

SEQ ID NO: 455 - DNA, 5262 bp, Homo sapiens
ccgcgcgtgctcccgcccctcgccgccgctcgctcgctcgccggccggcggcctccgctcggccccctccctcagctccggtgcgcggcggccgacgacccgcgcggcctgggcctcggcccgcgccaccggcgcccgcgcggagcggcccgggggccctcacgcaggcccatggcggcggccgcggcggcgctctcgggcgcgggcacgccacccgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaacgacagaaccatttctacttcatttggaaaaagattcagtcttttatcacaggcccttttgaaactcagatcccaggtctctccgtggtatgtttgtatttggggtgtccctccggctctaggcggcctctgacctgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggcccttcccgagtgtgccggccgagggccgagggccgtgcacatggggagagggcgtcagcctgatggctgagcttttaaatgtcatcatcataacattatttatttaaatgtagttattttggtatttaatttttttttagagaggaaaaaacctgtattttcctggtgggatgaaatagggatgaaatggctcagaatggtatatttaggcaattttaaaacatttattatttacataaagaccaaatatgatgaatctgttccgtgaattgtgtcggccctcagcatggggctggggcagcgtcactgcggtgacgcccattgaaaggtatgaaatgactgcacactagctggattatcactcagccgtttaagaaataaaagcaaaaccatcacgtgactgagaccgtgtgtgtgaccgcagcaaagcgcagcgtgtggatggatcagagcccctcggtgcagctgtctgcatcttccaagcactttacagataccttggaatgtatatttttgtcttcttactcagaaggtttgcagtttgtaaaataatcaggattctgctctgtcctgtgtgtggggtcagctccctccacagagggctccagctctgttggtcacagctgatggggttctctgattgataggagacgagctcttgagctctaaggaacagtgaggtcgccggtggggagcttggctgggacaccaagcaaatgcatcgtatgtccccttggagacgtttttatgcagctgtgtatgttactatccagaaggagtcgggggtagactttcccgtgtaagctcagtccataaactggttacttctgatcctggaacgtggacttcacatgataggtctggatctgtttctgttgggatcacaggtaaggaaaatgtccattcaaatggtaaagaagggaggagggtgttttttttttttttttttgccgtaggcaccattctgcatcttgaacccagactgaagtgtgcctctcacagatggaaggtgcacacgctcctgtctcctcctcactctgccacgttcacttggctttttcattggtacctaggaatttaagaatatcgaagcgagagcagtaacaaaccatagatgagcagactcccacaccgggttttcttgcccgtctttaaggcactgtttctaaattttgaacttagctctgaatccccaagaacttgagcacagcaagggttgctgagctgctgtcgccgcagccctggcccctggtgctggagctgcagcacctttgggagaggtcctgcgtcgtcctcagctgcgtcgctgtgaactcccgctctccactgtgttcctcagtgtctgcttttcaggaagtctgctgtgacctttgcccaacttctgagctcctcagggactaggaacaatttcagtagctttgccctgaaccaaacgagaaaacaaaagggaactcccgtatgacccacgtcacgtggtgcactcagagtgtgtgcggcatgatcctcggttgctcctcctctcactttagtagagtacgcggtggacagctgatctccttcagtcgtctacccacttccgtcattgtcctccgctagaataacagagtagttggtagtcatggccagaaggggggtgggggcagtgtgaggacttggggtttctgtgctgtgtgacacaaggagataagtgacaatcttgaagtcctaacttccactattctagaaagtatagtggtgatttgtgtgcaaagatttgaagttttaaaaaagtaccaagttcctgaaattcaataaaatatttttattaattttaatggaa

SEQ ID NO: 456 - DNA, 1637 bp, Homo sapiens
ggcaagacgcctcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaaaaaaaaaaaaaaaaaaaaaaaaaa

SEQ ID NO: 457 - DNA, 6123 bp, Homo sapiens
aaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcagggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaaaaaaaaaaaaaaaa

SEQ ID NO: 458 - DNA, 2838 bp, Homo sapiens
gggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaagaagcccaaggccatccgcaagctgcacttcgaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcacgccccgaacccgagtccgcgctgggggagcctcgcccccgcccccaccgggtgaaagtgtcgtctccgcttctctcggtgtggcgtgacggtaaccccatactctccttttgactccttttggaacccccacttttacgttgtgtccctccgcctcccccatggcgcaacaggagtcagtctctttctgtacaagggagaaaagctgtacgcgtttgtctcgtggttggaagcctccccttggcggggagaagctttttttcttgctagtattcgctgtgttcatggtctagaaatgcggtctggtctcgcctcgcctaccaatctctgctctctatgtatgtagcgtacgggttgttttgggtgaatcttgaggaataaatgcctttatatttcacaggctgtaaattgaacttcccacacgattagctttattatggcttgtgaactgctggagtctggctttacctttttgtatgtgaacaaatcaaattgcttaaaaaagagttttctttagtatagccacaaatgccttgaactgttgtctgggattgttttgtggggggagggaagggagtgttccgaagatgctgtagtaactgcctcagtgtttcacgtaagactttttggtttgatcatctttgttgaggtaggactatcagttccctctaaatgtatatgttgatttatgagtaattgttatttattctttatttatttatattaattatgaagattatgatattatttgattgcagatttttttggcgcgctgccccctccccaccctgccactcttgacattccactgtgcgttttagaagagagcctttttctaaagggatctgcttaaagttttaacttttatacctatctgagtgaattacagacaacctatcatttattctgcttcgagggtccccagggcccttgtacaaccgacagctcttacttttaaatgcaatctcttttctacatacattattttcttaattgttagctatttatagaaagcttcaatagaactgtttcaactgtataactatttactattcaaataaaatattttcaaagtcaaaaaaaaaaaa

SEQ ID NO: 459 - DNA, 3024 bp, Homo sapiens
cgggagaaagccccgcccccggcgcccgctcccactcctgattggccgggccagcccggggaggcccggcgggaccccggcccgcgtctcagctataaagatagccccggcatgacagccgcggcgaagctcttctagttcatctgctggccggctctcagtccccgtggcgccccctttcctcttgtcccagagcgctctcgactccaccatgccaaggggattcctggtgaagcgaactaaacggacaggcggcttgtaccgagttcgccttgcggagcgtgtcttccctctgctggggccccagggggcgccgcccttcttggaggaggctcccagcgcctccttgcccggcgcggagcgggcgacaccccccacccgagaggaaccaggaaaggggttgacggcggaggcggcccgggaacagtcggggtcgccatgtcgggcggctggggtgagcccggggacgggcgggcgggaaggcgcggagtggcgggcgggtggcagggaaggtcccgggcccagccccagccccagccccagtccagcgaagccggcaggcgcagagctgcgtcgggcgttcctggagcgctgcctcagctcgcccgtctccgccgagtctttccccgggggcgccgccgccgtggccgctttctcctgctccgtggcgccagcagccgcaccgaccccgggggagcagtttctgctgccgcttcgggcgccgttcccagagcccgcgcttcagccggaccctgcgcccctctcggccgcccttcagagtctgaagcgggcggccggcggcgagcgccgcggcaaggcacccacggactgcgcgtctggacccgcggccgcgggaatcaagaagccaaaggccatgaggaagttgagctttgccgatgaggtgaccacatcccctgtcctgggcctgaagatcaaggaggaggagcccggagcgccgtcccggggcttggggggcagccgcacgccactgggggagttcatctgccagctgtgcaaggagcagtacgcagaccccttcgcgctggcccagcaccgctgctcccgcatcgtgcgcgtagagtaccgctgccctgagtgcgacaaggtgttcagctgtcctgcgaacctggcctcccatcgccgctggcataagccgcgtcctgcggctgcaaacgccgccacagtctcctccgccgacgggaagccgccttcttcgtcgtcttcgtcctcccgggactccggggccattgcatcttttctggcggagggaaaggagaacagccgaatagagcggactgcggatcagcacccgcaggccagggacagctccggggcggatcagcacccggacagcgccccgaggcagggcctccaggtgctgacgcatccagagccaccgctgcctcagggcccctacacggagggggtgttggggcgccgggtacctgtgccgggcagtaccagtggtggcaggggatccgagattttcgtgtgcccatattgccacaaaaagtttcgtcgccaagcctatctgcgcaagcacctgagcactcacgaggcgggctcggcccgtgcgctagcgccgggctttggctccgaacgcggtgccccacttgccttcgcttgcccattgtgcggagcgcacttccctacagcagatatcagggagaagcaccggctgtggcatgctgtccgcgaggagctgctcctgcccgctctggcgggggctcctcccgaaacgtcgggccctagcgggccatctgacgggagtgcccagcaaattttctcgtgcaagcactgcccgtccactttttttagctctccagggctgacccggcacatcaataagtgccacccctcagaaagccggcaagtgctgctgctgcagatgccactgcggcctggctgctgagggacgagagaccaggatgatttcgaggttggccttagaggaaacagatcatgggaatttctgtggggctttcttcaacttgcaagtttactttcattccttcctatgttttaatcccctaaaattctccctgtagtcaatgttccaccagaggagcggacagtgaaatgtaatatccctctctagagcaggtatgtatatggtataaaccttgagatcaaagactgtcagctttaaatccttctcactttccccactaaaataggatttttccccttaaaactctggagaccctaacgaatcctatatgatttgtaattcctatggaaagtcgcggtgaatgcgtgcatgtctcaatgtccacaaaggattctggctaccctttggtagccaatgttttttttgtcttgtcatcacaggcgcctatacagcttctgtctcaatagggtcagatattttgcactgtatattctgtgaattaaaagttatgtgattggtgtcaaacttaaggagattcaagacctggcagaaaatgtaagaggatttttgctgcttttggggtgcatggggatctcccctgtaaactttcctttgcccaattatatgtacatgtccattcttaagttggtgtttggaggtggggaggatgctactttactggagttgagacaccccctaaaattctcaccctcagctattttgtgggcagtattcaggaagagctacttcaaacctttctttaaatggctttttggaaatacagaagtcgtttcctcaagtttgactgttttaatggggtttcacccaaattgtttaatgcttctgctgtaaatgtcatactgtgtattcattatgaaaatatgtacagcttaaggaagatgttaacacctgtaatccactaaggaactgaatggcaatttgctcaatattcagtattttcttttcagcggcaacttgtttttgatttttttaaaaaaccatttcagtgtacattgtgtactaattccctactagccagtttgggacattggctgagcactgcctgacagaaagcccgtatttgtaagatgcttaccaccaaataaatgtacatagactgtgaaaaaaaaaaa

SEQ ID NO: 460 - DNA, 2573 bp, Homo sapiens
gggtggcgccgggagtgggaacgccacacagtgccaaatccccggctccagctcccgactcccggctcccggctcccggctcccggtgcccaatcccgggccgcagccatgaacggcgaggagcagtactacgcggccacgcagctttacaaggacccatgcgcgttccagcgaggcccggcgccggagttcagcgccagcccccctgcgtgcctgtacatgggccgccagcccccgccgccgccgccgcacccgttccctggcgccctgggcgcgctggagcagggcagccccccggacatctccccgtacgaggtgccccccctcgccgacgaccccgcggtggcgcaccttcaccaccacctcccggctcagctcgcgctcccccacccgcccgccgggcccttcccggagggagccgagccgggcgtcctggaggagcccaaccgcgtccagctgcctttcccatggatgaagtctaccaaagctcacgcgtggaaaggccagtgggcaggcggcgcctacgctgcggagccggaggagaacaagcggacgcgcacggcctacacgcgcgcacagctgctagagctggagaaggagttcctattcaacaagtacatctcacggccgcgccgggtggagctggctgtcatgttgaacttgaccgagagacacatcaagatctggttccaaaaccgccgcatgaagtggaaaaaggaggaggacaagaagcgcggcggcgggacagctgtcgggggtggcggggtcgcggagcctgagcaggactgcgccgtgacctccggcgaggagcttctggcgctgccgccgccgccgccccccggaggtgctgtgccgcccgctgcccccgttgccgcccgagagggccgcctgccgcctggccttagcgcgtcgccacagccctccagcgtcgcgcctcggcggccgcaggaaccacgatgagaggcaggagctgctcctggctgaggggcttcaaccactcgccgaggaggagcagagggcctaggaggaccccgggcgtggaccacccgccctggcagttgaatggggcggcaattgcggggcccaccttagaccgaaggggaaaacccgctctctcaggcgcatgtgccagttggggccccgcgggtagatgccggcaggccttccggaagaaaaagagccattggtttttgtagtattggggccctcttttagtgatactggattggcgttgtttgtggctgttgcgcacatccctgccctcctacagcactccaccttgggacctgtttagagaagccggctcttcaaagacaatggaaactgtaccatacacattggaaggctccctaacacacacagcggggaagctgggccgagtaccttaatctgccataaagccattcttactcgggcgacccctttaagtttagaaataattgaaaggaaatgtttgagttttcaaagatcccgtgaaattgatgccagtggaatacagtgagtcctcctcttcctcctcctcctcttccccctccccttcctcctcctcctcttcttttccctcctcttcctcttcctcctgctctcctttcctccccctcctcttttccctcctcttcctcttcctcctgctctcctttcctccccctcctctttctcctcctcctcctcttcttccccctcctctccctcctcctcttcttccccctcctctccctcctcctcttcttctccctcctcttcctcttcctcctcttccacgtgctctcctttcctccccctcctcttgctccccttcttccccgtcctcttcctcctcctcctcttcttctccctcctcttcctcctcctctttcttcctgacctctttctttctcctcctcctccttctacctccccttctcatccctcctcttcctcttctctagctgcacacttcactactgcacatcttataacttgcacccctttcttctgaggaagagaacatcttgcaaggcagggcgagcagcggcagggctggcttaggagcagtgcaagagtccctgtgctccagttccacactgctggcagggaaggcaaggggggacgggcctggatctgggggtgagggagaaagatggacccctgggtgaccactaaaccaaagatattcggaactttctatttaggatgtggacgtaattcctgttccgaggtagaggctgtgctgaagacaagcacagtggcctggtgcgccttggaaaccaacaactattcacgagccagtatgaccttcacatctttagaaattatgaaaacgtatgtgattggagggtttggaaaaccagttatcttatttaacattttaaaaattacctaacagttatttacaaacaggtctgtgcatcccaggtctgtcttcttttcaaggtctgggccttgtgctcgggttatgtttgtgggaaatgcttaataaatactgataatatgggaagagatgaaaactgattctcctcactttgtttcaaacctttctggcagtgggatgattcgaattcacttttaaaattaaattagcgtgttttgttttg

SEQ ID NO: 461 - DNA, 3567 bp, Homo sapiens
agagctcgccactccttagtcgaggcaagacgtgcgcccgagccccgccgaaccgaggccacccggagccgtgcccagtccacgccggccgtgcccggcggccttaagaacccggcaacctctgccttcttccctcttccactcggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataaggacgtgtgtaaatatgtacatttgtctttttataaaaagtaaattgtttataaggggtgtggcctttttagagagaaatttaacttgtagatgattttactttttatggaaacactgatggacttattattggcatcccgcctgaacttgactttggggtgaacagggacatgcatctattataaaatcctttcggccaggcgcggtggctcacacctgtaatcccagcactttgggaggccgagatgggtggatcacctgaggtcaggagttcgagaccagcctggtgaaactccatttctactaaaaatgcaaaaattagctgggcgtggttgcgggtgcttgtaatcccagctactcaggaggctgaggcaagagaatcgcttgaacctgggaggtggaggttgcagtgagccgagaacatgccattgcactccagcccgggcaccaaaaaaaaaaaaaaaaaaaaaaacctttcatttggccgggcatggtggcttatgcctgtaatcctggcactttgggaggccaaggtgggcagatcacctgaggtcaggagtttgagaccagcctggccaacatggtgaaacctcatctctactaaaaatacaaaaattaggccgggcacggtggctcacgcctgtaatcccagcactttgggaggcagaggcgggcggatcacgaggtcaggagatcaagaccatcctggctaacacggtgaaaccccgtctctactaaaaatataaaaaattagccgggcctagtggcgggtgcctgtagtcccagctactcgggaggctgaggcaggagaatggcatgaaccccggaggcagagcttgcagtgagccgagattgcaccactgcactacagcctgggcgacagagcgagactccgtctcaaaaaaaaaaaaaaaaattagccgggcctggtggcgggcgcctgtaatcccagctactgtggaggctgaagcacaagaatcacttgaacccgggagatggaggttgcagtgagctgagactgtgccactgcactccagcctgggtgacaagagtgagactttgtctcaaaaaaaaaaaaatccttttgtttatgttcacatagacaatggcagaaggaggggacattcctgtcataggaacatgcttatataaacatagtcacctgtccttgactatcaccagggctgtcagttgattctgggctcctggggcccaaggagtgttaagttttgaggcatgtgccataggtgatgtgtcctgctaacacacagatgctgctccaaaaagtcagttgatatgacacagtcacagacagaacagtcagcagcccaagaaaggtcctcacggctgctgtgctgggtagcacttgccatccagtttctagagtgatgaaatgctctgtctgtaccgttcaatacagtaggcactggcactagccacatgtgccagctaagcacttgaaatgtggccagtgcaataaggaattgaacttttaattgcatttaataaactgtatgtaaatagtcaaaaaaaaaaaaaa

SEQ ID NO: 462 - DNA, 2302 bp, Homo sapiens
agccgcggctcttcgcagtttcctctccttgttttgctttcgatctggactgttctcaggcaagccggggagtaacttttagttttgctcctgcgattattcaactgacgggctttcatttccatttcacataccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaaaaaaaaaaaaaaaaa

SEQ ID NO: 463 - DNA, 1614 bp, Homo sapiens
ggaaacccaaaaaagggcataggggcgggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatgaa

SEQ ID NO: 464 - DNA, 5314 bp, Homo sapiens
agtttcaccgctcgatcttgggacccaccgctgccctcagctccgagtccagggcgagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcagagctgcaagcgtttgctcaccacggccgctccctgccaagattccaggtgactctatgctttggagaggagtttccagaccctcagaggcaaagaaagctcatcacagctcacgtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaattcagaagtggagatttcagttcagcggttgaggagaattgcggcgagacaagcatggaaaatcagtgacatctgattggcagatgagcttatttcaaaaggaagggtggctttgcatttcttgtgttctgtagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccgccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctcccgaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaatttgtta

SEQ ID NO: 465 - DNA, 2870 bp, Homo sapiens
gcccggcaggttggcggaccggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagatgcagtgcagtctggcccccacatgacaccctattctttactcaaagaggatgtcaagtggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaatgaatgttaaaaacagactcagctgtttctttccttttactactaccagttgctcccatgctgctccaccaggccctgtttcggatgccaactggcccactccccaagcacttgcccccagcttgcgaccattggcactgggagggcctggcttctgggctgatgggtcagttgggccttcataaacactcacctggctggctttgccttccaggaggaagctggctgaagcaagggtgtggaattttaaatgtgtgcacagtctggaaaactgtcagaatcagttttcccataaaagggtgggctagcattgcagctgcatttgggaccattcaaatctgtcactctcttgtgtatattcctgtgctattaaatatatcagggcagtgcatgtaaatcatcctgatatatttaatatatttattatattgtcccccgaggtggggacagtgagtgagttctcttagtccccccagagctggttgttaaagagcctggcacctacccgctctcacttcatctgtgtcatctctgcacactccagcccactttctgccttcagccattgagtggaagctgccccaggcccttaccaggtgcagatgcccaatcttgatgcccagccatcagaactgtgagccaaataaacctttttctgtataaaaaaaaaaaaaaaaaaaa

SEQ ID NO: 466 - DNA, 2171 bp, Homo sapiens
gagctcggcgcacctgggctgggcaggtaagggctggtgcgggacggggagaggaacctgcagtccctacttgggtagagccaggcgccccttggctaagacgtcgaggagcgtggtagcgacgggtgatcttcgctgcggacttggttcggagggacgtccgcttctggtggacagattgagcaaagaatctttgagcggtcaagggaaagacaagccgactcttcagatccctgtggacacactgcctgctcttccatatcatggccctccacccccgcagagtccggctaaagccctggctggtggcccaggtggatagtggcctctaccctgggctcatctggctacacagggactctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgctttggggaagaatggccagatgggaaaccattggaaaggaaactcatcttggttcaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttagatttaaccagcttttaaatctctcttttctctaacagtgttagaagtttgtgattctccaaatatgcctagatttaaagctgatttaatttatggaaaaatcacccttcagactttgcttttctttttcaaatctcctaatggtagtatgatatagcatagtagaaggagatttggcctgggagtttggacaccaaagttctagctgcagctttgcttccaatgtgaccttgaacaagtcctttaacctctgggcttcagatttattgcttataaagtgaagagattggagtagtgcctgaaattgcatccagctttagaacggactcaatgaccttcttctacttgtacaaggctaaactgcctggaacagaatccttctgcattgttcttgtaccacatttttccttggttttgttaaagtttcctcaagcacta

SEQ ID NO: 467 - DNA, 1972 bp, Homo sapiens
gaaactcccgcctggccaccataaaagcgccggccctccgcttccccgcgagacgaaacttcccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaaca

SEQ ID NO: 468 - DNA, 645 bp, Homo sapiens
tggaacctggtatggtatttcagacgtcttgacttgcccagtaacttacctggattgattctttcttctgagcactgtaacaagtattcaaagattccccgccactgtatgtctgaagatagcaaatatgttttaatacaaatgttatgggacaatatgaagttacatcaggatccgggacagcccttgtacattctctggaatgcacacacccaaaaatatccaatggtccatttattgcaaaaaagtgataactcatttaaccaggaactgttgaaaagtatggtaaaaagcattaaaatgaatgatgtctatggaccaatgagtcagattttagagacactgaataagtgtccacattttaaaagacagaggagtttatacagagaaatactatttctctcacttgtggcactgggaagagaaaacattgatatagatgcttttgataaagagtacaagatggcatacgatcgtctcacacctagtcaagtcaagagtacacacaactgtgatagaccaccaagtacaggggtgatggaatgtcgaaaaacctttggagaaccttatctttaagatgtatttgtatgtgtaaacattcaatgtatattgtatagtcagtgtataaaataacacttttagacg

SEQ ID NO: 469 - DNA, 280 bp, Homo sapiens
cgcggatctcagcctcttctcgcagatgggctcgcagtatgaactgaaggacaaccctggggtgcaccccgccaccttcgcagcccacacggcgccggcttattacccctacggccagttccaatacggggaccccgggcggcccaagaacgccacccgcgagaacaccagcacgctcaaggcctggctcaacgagcaccgcaagaatccctaccccaccaagggcgagaagatcatgctggccatcatcaccaagatgaccctcacgcaggtctccacc

SEQ ID NO: 470 - DNA, 245 bp, Homo sapiens
ccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccc

SEQ ID NO: 471 - DNA, 259 bp, Homo sapiens
cgcgcagtatgagctgaaggacagccccggggtgcagcatccggccgcggctgccgcgtttccgcacccgcaccccgccttctacccgtatggccagtaccagttcggagacccgtcccgtcccaagaacgccaccagggagagcaccagcacgctgaaggcctggctcaacgagcaccgcaagaacccctaccccaccaagggcgagaagatcatgctggccatcatcaccaagatgaccctcacccaggtgtccacc

SEQ ID NO: 472 - DNA, 2229 bp, Homo sapiens
tcctgcttcgccctcccagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgctgaacagctttgattccaaggatggttcgggatctgcgcatgggggcctggcaccagccgctgccgcctactacccttacgagccagctctgggccagtacccctatgacaggtatggaaccatggacagcggcacgcggcgcaagaacgccacgcgcgagaccaccagcacgctcaaggcctggctgcaggagcaccgcaagaacccctaccccaccaagggcgagaagatcatgctggccatcatcaccaagatgaccctcacacaggtctccacctggttcgccaacgcgcgccggcgcctcaagaaggagaacaagatgacgtggccgccgcggaacaagtgcgcagacgagaagcggccctacgcggagggcgaggaggaggaggggggcgaggaggaggcgcgggaggagcccctcaagagctccaagaacgcagagcccgtgggcaaagaggagaaggagctggagcttagtgacttggacgacttcgacccgctggaagcagagccgccggcgtgcgagctgaagccgcccttccactccctggacggcggtctggagcgcgtccccgccgcgcccgacggcccggtcaaggaggcctcaggcgcgctccggatgtctctggccgcgggtggcggagctgctctggacgaggacctggagagggcccggagctgtctccgcagcgcggcggccgggccggagccactgccgggcgcagagggcggccctcaggtctgcgaggccaagctggggtttgtgccggcgggggcgtcggcaggcctggaggctaagccgcgcatctggtccctggcccacacagccaccgccgccgccgccgccgccacctccctgagccagactgagtttccgtcgtgcatgctcaagcgccaaggtcccgcggcccctgcggctgtgtcctccgcgcccgccacgtccccgtctgtggcccttccccactctggcgccctggacaggcaccaggactccccggtaaccagtctcagaaactgggtggacggggtcttccacgaccccatcctcaggcacagcactttgaaccaggcctgggccaccgccaagggcgccctcctggaccccgggcctctgggacgctcgctgggggcgggcgcgaacgtgctgactgcacccctggcccgcgcctttccgcctgccgtgccccaggacgccccagctgcaggcgccgccagggagctgctcgccctgcccaaggccggcggcaaacccttctgcgcctgaggcgggcgggtcccgagcccaggagggaacccgcgctcaggcggacggcgccgactcttttcactgagtttccagaggaagactagcgcggccaccgcgaagccgccaacccaccggagagggggcttctgaacttggactcctgggaacatggacaagcccggcgctgccacgccggggcctccaccgcctgggcctgagcctgaccgggccattcccaaatttgggacgcggaaggagaggctctcggagcagaagaggccagataccctgaagcataaagtttacgtcaaaagtttacatggagaaggcggttccgttctgaagcgtggtctgctgtcccctgggcgtgaggcctcctgggcctgtcgggcctccgatttcatcctcagcacgtaatgctcaccaacagcacttgcactgagttgactcttgcacactcttgactccataatatgatgctttttaagatgtatgttcacaccaataattgcctgcttcagaggctaatataacaaaaccaataaaaccgagtgatggtgaaaaaaaa

SEQ ID NO: 473 - DNA, 2078 bp, Homo sapiens
atgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgccgggctacaactcgcacctccagtacggcgccgaccccgcggccgccgccgccgccgccttctcctcgtacgtgggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacatcgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacagagagagaaaataaactacccctcctattcagaagtttatagtttatggagatggatgacataaaaatgtaaacatctccacacaaaaaaaaaaatgtcttaaccaaccgaaaagaaaaattaaaaaaggatttgtattaaatcttattctgtatatttaatgtagcatttttgtatttaaattgataattcaatatctttgaagtaaattatgaaatcaagacacctgtacaggcatttaatgtttttttgtaatataaatatatacatttgtgtttcccccaaaactgtttcatagttaaaaaatacaagtttaatttaattttttacacctattgattctgctgggtatgagctaaagtattacagaaaggaaacaggttatactcttagatttaaaaagtgaaagaaactgcaggcgcctttgtaaaatgcaaaatatttaattaaaagagattttaacataatgagagccactcattactttttagaagcctcaataaactgtccattgccttggtcaaaaaaaaaaaaaaaaaa

SEQ ID NO: 474 - DNA, 808 bp, Homo sapiens
attgatagctctttctcgattccgtgggtggtggtgcatggccgttcttagttggtggagcgatttgtctggttaattccgataacgaacgagactctggcatgctaactagttacgcgacccccgagcaggaactgagacacctcactgctgggggcgcggaacagctgggctgagacgggaactcgacagggaagagagagacgggccagggacagccaccatgtccttcccacactttggacacccgtaccgcggcgcttcccagtttctggcgtcggcaagttccagcaccacatgctgcgaatctacccaacgctctgtctcagatgtggcatcaggctccaccccagcgcccgctctctgctgcgcaccctacgatagtcgactgctgggcagtgcgcgaccggagctgggcgccgccttgggcatctatggagcaccctatgcggccgctgcagctgcccagagctaccctggctacctgccctatagcccagagcccccctcactgtatggggcactgaatccacagtatgaatttaaggaggctgcagggagttttacatccggcctggcacaaccaggagcctattatccctatgagcggactctggggcagtaccaatatgaacgatatggcgcagtggaattgagtggcgccggtcgccgaaagaacgcgacccgggagaccaccagtacactcaaggcctggctcaacgagcaccgcaaaaacccctaccccactaagggtgagaagatcatgctggccatcatcaccaagatgaccctcacccaggtgtccacc

SEQ ID NO: 475 - DNA, 10932 bp, Homo sapiens
gcagaactttggcgggcaaggagacaaacagccacactgtgctgccggggaagagaagaagaaggaaaggccagacacacaggcgtcgtgcagctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggacccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaagtattttttgggaaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaagggagttgtatttgtaacggaagaagagaagaataaaaaatattagttttaaaagtggcctatgtgactgcttttctaaaaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttcaccccttctcacttgtatgttctgtaaagtgtatttctactttggtaggaagaaagacttgatttaatatttc

SEQ ID NO: 476 - DNA, 6393 bp, Homo sapiens
gtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacggaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccacgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttacaaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatccccgtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatgaaaaaaaaaaa

SEQ ID NO: 477 - DNA, 5502 bp, Homo sapiens
cattttaaaaaagatccggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcttatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatactatgaaaaaaaaaaaaaaaa

SEQ ID NO: 478 - DNA, 4007 bp, Homo sapiens
gccccagcccagccccgcggggaggctcccgcagcccagggacctcgagctttccccgcgccgggcgctgcagccgggcccctcccgcgaggcgcccggcagcctgaggcttccttttggttcccgccccgggacgggaggctccgtccgctccctggacagccggggtgctccctccttctccctcccgcgctctcctcccccgtccgtttgcagggaggtgctctcctcgggcggcggggaaggcggggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcttcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttcctttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttacttacatagccgccttgcgtggtgtctgcctggggaatgggtgcaaggccctctcagggtcggagactgtttggagcctctgctataggcctgttcattttcacaacagctctcctatttcacagatgaggaagctaaggctcagagacattaagccacctgcagttactattttgagagcagtcagagtgttcgctcactctgcagatgttttctgagggcctgttgtgtgtgccaggccctgagaattcactggaggatgaaacagacctaagtcttgcccttgtggggcctccagtaaggagtgaatcctgtgcttgctccataagttgtctcatttcgtcttcatggcagccttgccagggaacagcacttgtccccaattcacagatggcgaattagaggtccagggaattaaactcgcagacaccatttgttgaagacttattttgtgacaagcagacatagtctcttcccttctcacaagagcacaaactaggcacgattcttctcattttacagatggtttaactgaggctcagagaaggtaagcgacttatccaaggtaacccagctagcaagggatagagctggtgtttgaactctccctccagaggcctgtgactctcctcctgtcaccaacccactatgattgtcctcatggttgaataggaagcttatgaggccacagttatagatttagtttctgggaaggctggatagagttccaggttgtcccatgatcacagagtgaaccaactaccctggtcaatgtgtgtctgacccagggaagggtgtggatggcttctctgccccctcacctcgacagctgaatccctgccacccagggccggagcagctcagtggcattcactcagtgcctgctgtgtacctggcactcggcagttctcaaggcatgtcacgcatgaggaaggcgggagaggtgtttttagcttccttgtatactgaagcttgcaaaggctacagtttacccaactaaacttgactcctgcattctaatcatgtgttctttctcctccatccctggacttaggataactagttgctggtgatgacttcgtgtcaagaacagcagtgaacctgggttgcttcccaaattgtggacgaggccttctgggatgggcagaagtggagaatggtgattaacacacctgtgatccctccctcgctcactcctctcagtttccctccacccaacacacttggtgtggactcccctgcaccccgccctagaaacaggacctggtcctctcactgtcagctgtggcagaaggttgtggcagcgggttgccttctgtctcgggggtcttgaggctgtcggtccggacgatgcaggtgaggcagtgtcagttctgcatcaggaacccctcgcgctgtaatcctttgatatttttcaagccatgagaaaaatgaagtggacttaccagggtccctccagtgacctagtggatgttcttacaggactgccgtgtgccactggctgtggcttccctggtcctgtgcttggccaccgggagctggcatctccaaaatagagcctccttagcctgtgcaggtgggctgtcttccaaagtcaccacaccagtgacttgtgctgtgcggagccttcctcaccaggaccactggctgctcctgtggctagaagtcacaattataggcttcattgcaagagccagcatttgagtttcttctgggcacctgccactgtgcatgtgtgacctcaactgctttgtgcaccctgactggggggtaggtgctagcgttccaacattacagatgagaaaaccgaggcacacagaagaggtaacctgcccaaggtcacaggtgttaggtggcagagccaagatgttattgtcagtctgacttcaggtgcataaaacctgaggctgagcctccccatgagaggaaaaatgtgtttgtggtgtgacctcagttgccagggaacttgtgcaggaagccgggagagatggcacagacccacctgtgctcacagtacatgttaagaattcccaagtctcaggcaaaccatctccaagggtgttcacagaagacacaccttaaaggcaaacgggttcatgatgtaatcttctattgactagctgtgaacctcatttttcttatctgtgaagtgggaacagtaataatccaagtctttttatggagttatcaagatcaaaaaaggaatggatatacaaagtgttttgtgaaataaaagctccctaaaatggtaaaaaaaaaaaaaaaaaa

SEQ ID NO: 479 - DNA, 5756 bp, Homo sapiens
gttttactaaagtgaatttttttttgtttgcttcgttcgtctttggctctttttttttccttcccaatttcggatttatttcaaggcgaatctggctttgggggaagaggaagaaaagtcggattacaagatcaaccaccaccaacaacaataaaaaccaccaggatatttttttgcaaatttctgacggctttaaattcatgaagcaattgtccccttttgcaatcagcatttggatctcagaatgagcaaggaaagacccaagaggaatatcattcagaagaaatacgatgacagtgatgggattccgtggtcagaagaacgggtggtacgtaaagtcctttatttgtctctgaaggagttcaagaattcccagaagaggcagcatgcggaaggcattgctgggagcctgaaaactgtgaatgggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggcccaggctgcaagcacaaaggaagtttgctcagtctcagccgaatagtcccagcacaactccagtaaagatagtggagccattgctaccccctccagctactcagatatcagacctctctaaaaggaagcctaagacagaagattttcttacctttctctgccttcgaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatgttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggctcaggacttacggaaacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcatagggggctgtgagctcgacctggcctgctttttccggctgattaatgagatgggcggcatgcagcaagtgactgacctcaaaaaatggaacaaactagcagacatgctgcgcatccccagaactgcccaggaccggctggccaagctgcaggaggcctactgccagtacctactctcctacgactccctgtccccagaggagcaccggcggctggagaaggaggtgctgatggagaaggagatcctggagaagcgcaaggggccgctggaaggccacacagagaacgaccaccacaagttccaccctctgccccgcttcgagcccaagaatgggctcatccacggcgtggcccccaggaacggcttccgcagcaagctcaaggaggtgggccaggcccagttgaagactggccggcggcgactcttcgctcaggaaaaagaagtggtcaaggaagaggaggaggacaaaggcgtcctcaatgacttccacaagtgcatctataagggaaggtctgtttctctaacaactttttatcgaacagcgaggaatatcatgagcatgtgtttcagcaaggagcctgccccagccgaaatcgagcaagagtactggaggctagtggaagagaaggactgccacgtggcagtgcactgcggcaaggtggacaccaacactcacggcagtggattcccagtaggaaaatcagaacccttttcgaggcatggatggaacctcaccgtcctccccaataacacagggtccatcctgcgtcacctcggtgctgtgcctggagtgactattccctggctaaatattggcatggtcttttctacctcatgctggtctcgagaccaaaatcaccttccatacattgactacttacacactggtgctgactgcatttggtattgcattcctgctgaggaggagaacaagctggaagatgtggtccacaccctgctgcaagccaatggcaccccagggctgcagatgctggaaagcaacgtcatgatctccccggaggtgctgtgcaaagaggggatcaaggtgcacaggaccgtgcagcagagtggccagtttgtcgtctgcttcccgggatcctttgtgtccaaagtgtgctgtgggtacagcgtgtctgaaaccgtgcactttgctaccacccagtggacaagtatgggctttgagaccgccaaggaaatgaagcgtcgccatatagctaagccattctccatggagaagttactctaccagattgcacaagcagaagcaaaaaaagaaaacggtcccactctcagtaccatctcagccctcctggatgagctcagggatacagagctgcggcagcgcaggcagctgttcgaggctggcctccactcctccgcacgctatggcagccacgatggcagcagcacggtggcggacgggaagaaaaagcctcgaaagtggctgcagttggagacgtcagagaggaggtgtcagatctgccagcacctgtgctacctgtccatggtggtacaagagaacgaaaacgtcgtgttctgtctggagtgtgctctgcgccacgtggagaaacagaagtcctgccgagggctgaagttgatgtaccgctacgatgaggaacagattatcagtctggtcaatcagatctgcggcaaagtgtctggtaaaaacggcagcattgagaactgtctcagtaaacccacaccaaaaagaggtccccgcaagagagcgacagtggacgtgcccccctcccgtctgtcagcctccagttcatccaaaagtgcttcgagctcatcatgaagatgccaacgcccgtggtcgatttatatatatttttttgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggggctgtattaatttgtattgccccatggctgacaaaagcctttttttttggttttgatttttttttttttgtaactgttggggggaaaaaggctttttaacccatttttgaagagggtgaagtttggagaacaaatttaaaaaccatcagtcatgtgagcagattttttagaagggataggagacacacgcgcacacacacacacacacgaaacttgaaatggctttgctttggctgtcgtcttctgccgtgtgccagatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatctttcttttaaaacttgtttcatttatgatcatgtagagagccactaggaggcctgcagttatttttgaatgtgaaaatgcatttgcgttcatcttgtctattttttctcttcatgttgtaacaaaaaggaaaaaagaaaaaaaaatcccatcccttttgtacatatgcctgtaaattgttttaaatacttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttgga

SEQ ID NO: 480 - DNA, 4907 bp, Homo sapiens
taatgggggtcgcccgggagtcggaagggggaggggaaagggaggaggcagccaaggaattgtttttttctctggccccgccctcgcccggggggccaatggtgatgatctgtttcccccggagcctcgcccagctcctgtgtttcagccaatgagcggcggaagcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttataaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcggcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataataaaaaaaaaaaaaaaaaa

SEQ ID NO: 481 - DNA, 3454 bp, Homo sapiens
ggagtttcggccttcgcctgctggaaaagcagtaggatcggccagtggcgacagcaggagctgagcctaagccctggcggggctttgggctgtagattcctgtctgactaaagggacctcaaaaaggagggaaaatggcttctgagtctgaaactctgaatcccagtgctaggataatgaccttttatccaactatggaagagttccgaaacttcagtagatacattgcctacattgaatcccaaggagctcatcgggcagggctagccaaggttgttcctccaaaagagtggaagccacgagcatcctatgatgacattgatgatttggtcattcctgcccccattcaacagctggtgacggggcagtctggcctctttactcagtacaacatacagaagaaagccatgactgttcgagagttccgcaagatagccaatagcgataagtactgtaccccacgctatagtgagtttgaagagctcgagcggaaatactggaaaaatcttacattcaatcctccaatctatggtgcagatgtgaatggtaccctctatgaaaagcatgttgatgagtggaatattggccggctgagaacaatcctggacttggtggaaaaggagagtgggatcaccattgagggtgtgaacaccccatacctgtactttggcatgtggaagacatcctttgcttggcacactgaagacatggacctctacagcatcaactacctgcactttggagaaccaaagtcctggtactctgttccacctgagcatggaaagcggttggaacgcctcgccaaaggctttttcccaggaagtgctcaaagctgtgaggcatttctccgccacaagatgaccctgatttccccgttaatgctgaagaaatatggaattccctttgacaaggtgactcaagaggctggagagtttatgatcactttcccttatggttaccatgccggctttaaccatggttttaactgtgcggagtctaccaattttgctacccgtcggtggattgagtacggcaagcaagctgtgctgtgctcctgtagaaaggacatggtgaagatctccatggatgtgtttgtgagaaagttccagccagaaaggtacaaactttggaaagctgggaaggacaacacagttattgaccatactctgcccacgccagaagcagctgagtttcttaaggagagtgaactgcctccaagagctggcaacgaggaggagtgcccagaggaggacatggaaggggtggaggatggagaggaaggagacctgaagacaagcctggccaagcaccgaatagggacaaagaggcaccgagtttgtcttgaaataccacaggaggtgagtcagagtgagctcttccccaaggaggatctgagttctgagcagtatgagatgacggagtgcccggcagccctcgcccctgtgaggcccacccatagctctgtgcggcaagttgaggatggtcttaccttcccagattattctgactccactgaagtcaaatttgaagagcttaaaaatgtcaaactagaagaggaggatgaggaggaagaacaagaagcagctgccttggatctttctgtgaatcctgcgtctgtagggggacgccttgtcttctcaggctccaaaaagaaatcatcttctagcctgggctctggctcttcacgggattctatctcttctgattcagaaactagtgagcctctctcctgccgagcccaagggcaaacgggagttctcactgtgcacagttatgccaaaggggatggcagggtcactgtgggagagccatgcacgaggaagaaaggaagcgccgctagaagtttcagtgagcgggagctggcagaggttgcagatgaatacatgttttccctagaagagaataagaagtccaagggacgccgtcagcctttaagcaagctcccccgccatcacccacttgtgctgcaggagtgtgtcagtgatgatgagacatctgaacagctgacccctgaggaagaggctgaggagacagaggcctgggccaagcctctgagccaactgtggcagaaccgacctccaaactttgaggctgagaaggaattcaatgagaccatggcccaacaggcccctcactgcgctgtctgtatgatcttccagacttatcatcaggttgaatttggaggctttaatcagaactgtggaaatgcttcagatttagccccccagaagcagaggaccaagccattgattccagaaatgtgcttcacttcgactggctgcagcacggacatcaacctttctactccttatcttgaggaggatggcaccagcatactcgtttcctgcaagaagtgcagcgtccgggtccatgccagttgctatggggtcccccctgcaaaggcttctgaagactggatgtgttctcggtgttcagccaatgccctagaggaggactgctgtttatgctcattacgaggaggggccctgcagagagcaaatgatgacaggtgggtccacgtttcatgtgctgtggcaattctggaagcaaggtttgtcaacattgcagaaagaagtccggtggatgtgagcaaaatccccctgccccgcttcaaactgaaatgtatcttctgtaagaagcggaggaaaagaactgctggctgctgtgtgcagtgttctcacggccgctgcccaactgccttccatgtgagctgcgcccaggctgccggtgtgatgatgcagcctgacgactggccttttgtggtcttcattacctgctttcggcacaagattcctaatttggagcgtgccaagggggccttgcaaagcatcactgcaggccagaaagtcattagcaagcataagaacgggcgcttctaccagtgtgaagtggtcaggctcaccaccgagaccttctatgaagtcaactttgatgatggctccttcagcgacaatctttatcctgaggacatagtgagccaggactgtctccagtttggtcctcctgctgaaggggaagtggtccaagtgagatggacagacggccaagtctatggagccaagtttgtggcctcccaccctatccaaatgtaccaggtggagtttgaggatggctcacaacttgtggttaagagagatgatgtatacacactggatgaagagcttcccaagagagtcaaatctagactgtcagtagcctcagacatgcgcttcaatgagattttcacagagaaagaggttaagcaagaaaagaaacggcaacgagttatcaactcaagataccgggaagattatattgagcctgcactataccgggccatcatggagtaggtgcttccagggtccaagggattctcagccatccaggcaagagcactctgggttccacagcacagcagacatggaacgctgaagtctctgaaagtgaagttgtaaaaagaaaaaaaaaaaaaaaa

SEQ ID NO: 482 - DNA, 3058 bp, Homo sapiens
ctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcgtcccgggcctcgctgaaggccaagctcctccgcagacaaattagtctgaaagaaaacagacactggagaaagactgaggaggagaggaaaccaagtctagaaaggaagaaagagcagaccaaaaggccggggctgtcgtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctagtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctggtgaggagcctggggcctggaggggcttggccgatcatggcctgggctgcagccctgcagggctgtctgctgcacaccctgtagcccacctgcgcacaaggcacttggggctgtccacgcctgctggaaaatgacactcagctggccctttaaatcagcttcctgcagagccttgggacctggcccagaaagaagatgaggaggccaggcctggtggctcatgcctgtaatcccagcactttgggaggccgaggcgggtcgatctcctgaggtcaggagttcgagaccagcctggccaacatatgaaaccccgtctctactgaaaatgcaaaacttagctctgcatggcgggacgtgcctgtgatcccagctactcgggagactaaggcgggagaattgcttgaacctgggcggcggaggttgcagtgagctgagattgcgccactgcactccagcctgggcgacagagtaagactctgtctcaaaaaaaaaaaagatgaggagagcaaaatgcagatgttgctggggccgcgtccccactaagggctgtgcatgtggcagcgctgatggggaggacgcatttgtccctgtgcactccggcctctgcacacgtgtctcgtgggcccctggaggctgggcccgcagccagtagcacccagcagcgtcctgcctgcttttcctgcctggtttatcttcccagccgcggacacagtgcctggtgttgacattcaggcttgcgtggaggtggggctggaagcagacagatcagtctggcagggtgggtctgctggggagaccacaagggtgggactgatgccggccacaaagcccgggctcccatgcactggtgcgaggtgcccacgagcccggcgggcttggatgccatgcttggagcccacaggtgctgggccacctgggcagggctgtgcaggcagtcacagaggctcatctggaaggggagccctctttccttgttcgtggagtggagtgtgcagtgggtcacgccggcctggccgggcacggccaggcgattaggaagccggcagcccgcgggtgatgcttccgaggcaccagtgactcagtccacaaacgtgggcgtaaaaggcctcatgattcaggtggagtgatggtgcgatgcgtggtgcagtgataagtcctcctgcccgacgccttatggatcatctgacatttccagaacgcagcctcttcattaccggtgcttgtaacgatgaattaaaaatccttttacacgaaaaaaaaaaaaaaaaaaa

SEQ ID NO: 483 - DNA, 3338 bp, Homo sapiens
gacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaaaaaaaaaaaaaaaaa

SEQ ID NO: 484 - DNA, 1832 bp, Homo sapiens
gagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcagggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttaaaaaaaaaaaaaaaaa

SEQ ID NO: 485 - DNA, 1890 bp, Homo sapiens
aggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcagcttcgcgtccccgggccgcttgttccccggggcgcccccgacggccgcggccggcagcatgatgaagaaggacgcgctgacgctgagcctgagtgagcaggtggcggcagcgctcaagcctgcggccgcgccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggcgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcggaagggggctccgagggggcgcagcctcaaaccctgcctttcctttacttttacttttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccagctcggcaaaaaaaaaaaaaaaaaaaa

SEQ ID NO: 486 - DNA, 2472 bp, Homo sapiens
ctttttacagctagacctgtgtgctgcaaggagctaaggccttcagtgtccccttccttacccaggtttctcacagaatggattcccagcgggaacttgcagaggaactgcggctttaccaatccacccttcttcaggatggtctaaaagatctcctggatgagaaaaaattcatcgattgcaccctaaaagcaggtgacaaaagtcttccttgccacagattgattttgtcagcttgtagtccttacttccgtgagtactttttatctgaaattgatgaggcgaaaaaaaaggaggtagtgctagacaatgtggatcctgctatacttgatttaatcatcaaatacctgtactctgccagtattgatctcaatgacggaaatgtgcaagatatttttgcattggccagccgctttcagatcccctcagtgtttactgtctgcgtttcttatcttcagaaaagacttgctcctggtaactgtctagccatcctaagattaggacttcttcttgactgcccgagactcgccatttctgcccgtgaatttgtgtctgatcgctttgtacagatttgtaaggaagaggactttatgcaactgtctccacaggaactgatctcagtcatttcaaatgacagcctaaatgtagaaaaagaagaagcagtatttgaggcagtgatgaaatgggtgcgaacagacaaggaaaacagggttaaaaaccttagtgaagtgtttgattgtatccgttttcgccttatgacagaaaaatattttaaggatcatgttgagaaagatgatataattaaaagcaacccagacctccagaaaaaaatcaaagttctaaaagatgctttcgcaggcaaactcccagaacctagcaaaaatgccgcgaagactggggctggtgaggtgaatggtgatgttggtgatgaagatttacttcctggttacctgaatgacattcccaggcatggaatgtttgtaaaagacctcatcctcttggttaatgacacagcagcagtggcttatgaccccacggaaaatgaatgctaccttactgcactggctgagcagattcccagaaatcattccagcattgttacccagcaaaatcagatatatgtggtaggaggactatatgtggatgaagaaaataaggatcaacctctacagtcatacttcttccagctcgatagcatagcatctgaatgggttggacttccacctctgccttcagccaggtgtctcttcggtctgggagaggtggatgataaaatctatgtagttgcaggcaaagaccttcaaacagaggcttcgctggattcagtattatgctatgatcctgtggctgcaaaatggaacgaagtaaaaaaactccctatcaaagtctatggccataatgtgatttcacataaagggatgatatattgtctaggaggaaagacagatgacaaaaaatgtacaaacagggtgtttatcttcaaccccaaaaaaggagattggaaagatctggctccaatgaaaattcctcgttccatgtttggagtagcagtccataaaggcaaaattgtgattgcaggaggtgtcactgaagatggtctttcagcttcagttgaagcttttgaccttacaacaaataaatgggatgtaatgaccgaatttccccaagaaagaagctccatcagtttggtcagcctggctggatctctgtatgcaattggtggttttgctatgattcaactggagtctaaagaatttgcacccactgaagtcaatgacatatggaagtatgaagatgataaaaaagaatgggctgggatgttgaaggaaatacgttatgcttcaggagctagttgcctagcaacacgtttaaatctcttcaaactgtctaaactgtgaacaaggtgacaaaacataatagattgggaggtggtttgtttggtgaatggggctttaatttattctgttttttaaaagcttgtacagacactcatgtagaaattattcaagaagttattgtctaagagatgagcagtaggtaagaaaacctcagtcattgactcttcaatgtaatgatcagagtttaaaaccattttctaataataaattaaatcttcagttgaacaaattattttgtgaatctgtttcactcaatggattgtaaagaaggctcctaaatttgagttgtttgctaatcatttcatttgcatcattagggtatccttaaactgattttctattacaattggaagtggagaatatgtgcatctacactaaaaaaatgtttaagatatcaaaaacctctcctcgtgcttcaaaatgacaggaatcctgtgcattatactaagaattacatgccataagatgacttcagaaatcctacttcagaagtgtaataaatggatggggaaatcgtttgatggggaaaagtctcttgtaagtaaaagtagtcaaattcaaatggcaaaaaaaa

SEQ ID NO: 487 - DNA, 2423 bp, Homo sapiens
cctcgaagacagctgctcagtctaagcaaaccccagcaggaaagcaggggtacagagaggagcccccttggcaccgccaccgcaccctaggccacccaccatggcgctgggcttggagcaggcggaggagcagcggttgtaccagcagacgctcctgcaagacgggctcaaagacatgctggaccatggcaagttcctcgactgtgtggtgcgggcgggcgagcgcgagttcccgtgccatcgcctggtgctggccgcctgcagcccctacttccgggcgcgctttctagccgagccggagcgcgcgggcgagctgcacctggaggaggtgtccccggacgtggtggcccaggtgctgcactacctgtacacatcagagatcgcgctggatgaggcgagcgtgcaggatttgttcgccgcggcacaccgcttccagatcccttccatcttcaccatctgcgtgtccttcctgcagaagcgcctgtgcctctccaactgcttggccgtcttccgtctcggcctcctgctcgactgcgcgcgtctcgccgtggctgcccgcgacttcatctgcgctcacttcacgctggtggcgcgcgacgctgacttcctcggactctcggccgacgagctcatcgccatcatctccagcgacggccttaacgtggagaaggaggaggcagtgttcgaggcggtgatgcggtgggcgggtagcggcgacgccgaggcgcaggctgagcgccagcgcgcgctgcccaccgtcttcgagagcgtgcgctgccgcttgctgccgcgcgcctttctggaaagccgcgtggagcgccaccctctcgtgcgtgcccagcccgagttgctgcgcaaggtgcagatggtgaaggatgcacacgagggccgcatcaccacgctgcggaagaaaaagaaggggaaggatggagccggggccaaggaggctgataagggcacaagcaaagccaaagcagaggaggatgaggaggccgaacgtatccttcctgggatcctcaatgacaccctgcgcttcggcatgttcctgcaggatctcatcttcatgatcagtgaggagggcgctgtggcctacgatccagcagccaacgagtgctactgtgcttccctctccaaccaggtccccaagaaccacgtcagcctggttaccaaggagaaccaggtcttcgtggctggaggcctcttctacaacgaagacaacaaagaggaccccatgagcgcatacttcctgcagtttgaccatctggactcagagtggctggggatgccaccgctgccctcgccccgctgcctctttggcctgggagaagctctcaactccatctacgtggtcggtggcagagagatcaaggacggcgagcgctgcctggactcggtcatgtgctacgacaggctgtcattcaaatggggtgaatcggacccgctgccttacgtggtgtatggccacacagtgctctcccacatggaccttgtctacgtaattggcggcaaaggcagtgacaggaagtgcctgaacaagatgtgcgtctatgaccccaagaagtttgagtggaaggagctggcacccatgcagaccgcccgctcactctttggggccactgtccatgatggccgcattatcgtggcagctggggtcaccgacacagggctgaccagttctgccgaagtgtacagcatcacagacaacaagtgggcacccttcgaggccttcccacaggagcgtagctcactcagcctggtcagcctggtgggtaccctctatgccattggtggctttgccacactggagacggagtctggagagctggttcccacagagctcaatgacatctggaggtataacgaggaggagaagaaatgggagggtgtcctgcgggagatcgcctatgcagcaggtgccaccttcctaccagtgcggctcaatgtgctgtgcctgactaagatgtgaccagctcaggcagactgaactaagcacccctcccatcctgcgaccctcactggcctggccttgtgggggctccagaaaagaggctaggagaggccagagtctacctggatccagttatggtgcctcaggggctgcgtcagccaaggaaagggaagtgctgcttagtcctggacttttgggcaagggtgagaaactagaggcttctccagtgttgccatatccccctaggttgtcttgatccatgaaccagaaccacagggcggtatcccaggccgtgtgctggccctgccccagcctagctgagtgtgctggcaaagttccccacaggactcagccttctcgtctgtccgatgggagcatccccatcaagtgcagtgtacagtgcagatatgtctccttctttaggaagaataaagtgccttctgagcaagcagctcagggtctgcatcagtgaaaa

SEQ ID NO: 488 - DNA, 3008 bp, Homo sapiens
agttctcccgggcgcctagcgggatcgccagcgcggcagtgggggcttccgcggctgcaagccagcgggtcctgtgagggcgagcggaggcggagaaagggcgcgggagtgagagagggtgagtcagccactgtctatgcaataaagggaggcctcaccgcgggatagggctgaattcagaagtgcggcccgtgccgcagtctgttccaggacgcggcttgtcttagcgtcagcgagggaaggttgaggaggagccagagcctggtcctgcagcctttctcgccgtcagcgcccgtcgccatctccaccatgcagtcccgggaagacgtcccgcgctctcgccgcctcgccagtccccgtggtgggaggcggcccaagaggatttccaagccctcggtttcggcctttttcacgggtccagaggagttaaaggacacggcccattctgcagccctgctggcacagctcaagtccttctacgacgcgcggctgctgtgtgatgtgaccatcgaggtggtgacgcctggcagcgggcctggcacgggtcgcctcttttcctgcaatcgcaacgtgctagcagctgcgtgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaatgtgcagcgcctgtacgcggcctccgacatgctacagctggaatatgtgcgggaagcctgtgcctccttcttagcccgacgtcttgacctgaccaactgcaccgccatcctcaagtttgcagacgccttcgaccatcacaagcttcgatctcaggcccagtcctacatagctcacaacttcaagcagctcagccgaatgggttcaattcgggaggagactctagcagatctaaccctggcccagctgctggctgtcctacgcctggatagtctggacatagagagtgagcggactgtatgccatgtagctgtgcagtggctggaggctgctgccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacatcctagagatccctttctctgctatgacccttactcgggggacatttacacaatgccatcccctttgaccagctttgctcacactaagactgtcacctcctcagctgtctgtgtgtccccagaccatgacatctatctagctgctcagcccaggaaagacctctgggtgtataaaccagctcagaatagttggcagcaacttgcagatcgcttgctgtgtcgtgagggcatggatgtggcatatctcaatggctacatctacattttggggggacgagaccctattactggagttaagttgaaggaagtggaatgctacagtgttcagagaaaccagtgggcattggtggctcctgtccctcattccttctattcctttgaactcatagtggttcagaactatctttatgctgtcaacagtaagcgcatgctttgctatgatcctagccacaatatgtggctgaactgtgcttctcttaaacgtagtgactttcaggaagcatgtgtcttcaatgatgaaatctattgtatctgtgacatcccagtcatgaaggtctacaacccagctaggggagaatggaggcggattagtaatattcctttggattcagagacccacaactaccagattgtcaatcatgaccaaaagttgcttctcatcacttctacaaccccacaatggaaaaagaaccgagtgacagtgtatgagtatgatactagggaagatcagtggattaatataggtaccatgttaggccttttgcagtttgactctggctttatttgcctttgtgctcgtgtttatccttcctgccttgaacctggtcagagttttattactgaggaagatgatgcacggagtgagtctagtactgaatgggacttagatggattcagtgagctggactctgagtcaggaagttcaagttctttttcagatgatgaagtctgggtgcaagtagcacctcagcgaaatgcacaggatcagcagggttctttgtaaatagtattttgagacactaagatgtttctactgctacggaatgtattttaaacacatatcgtttctttttcttggaaaaaaagttgattaggaccacagatttggtttagaaagggtaatattttgaaatactacaaggtttagacagtccatgaaatcgacctgtttaataatttaccatcctgaaagtccagaattaaaatatggaagcaagaactatataattgattaggatgcttggtaggtttttttcattgttcaaatattcattgcacagtggattgttttgattagttagtatgctttttttttaattaattcagtcttctgttaatttttaagttttggttagtgccacaaggaatttaactttttgatttgtataatagaaaactgaactaggaattgttagcggggttttgaaggatgtgtactttccttcaaaataaagtggtagattttcaaaattttacactagtcagttctttatattctaagttaaatgtagtttgtaaaattattttggttttcttctacaaaggaaaaaattggatttatatatataaggttactgcataatgatttcattttgataatgtgcagaatggcctcataagctcacagaaagcaaaaaaaaaaaaaaa

SEQ ID NO: 489 - DNA, 2020 bp, Homo sapiens
caggcagcaggcagcaggcgggcgcgctgtggctccgcgccgcgcggtccgggctctgttcattcatgattggtactcggccctccgagacccagcccgagcgcagggaggggagccgagtgtgcggcaggaggggcgggcggacggcggctcccgcaccgcacgcggcgctggctcggcagcctcggccgggcggccgctctggccccgtgtccagtgccaggcaggcttcagggcaccgtcctcggccctgggcgagggaaccgccgggccgggtcctcgcgcggggaagcggttccgaaggctcgcggggagcggctagccctgagtccctgcatgtgcggggctgaagaaggaagccagaagcctcctagcctcgcctccacgcttgctgaataccaagctgcaggcgagctgccgggcgcttttctctcctccaattcagagtagacaaaccacggggatttctttccagggtaggggaggggccgggcccggggtcccaactcgcactcaagtcttcgctgccatgggggccgtcatgggcaccttctcatctctgcaaaccaaacaaaggcgaccctcgaaagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgatattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttacactctcaaaaaaaaaaaaaaaa

SEQ ID NO: 490 - DNA, 2608 bp, Homo sapiens
aaagggtggggggcgggggtagggggagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaattggccgggtcttccgctttctcggtgacagttcgctcccttcagcattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgcaaaaaaaaaaaaaaaaaaaa

SEQ ID NO: 491 - DNA, 2361 bp, Homo sapiens
gctcccagcgccacggacgcccccgggccgagcggcggtgcgctcccgtgcagacccgtggacagacgcccctggccggtggactctcgagtctcgcttctgcaccctgcgtccctagacatgaatgtgaggagggtggaaagcatttcggctcagctggaggaggccagctctacaggcggtttcctgtacgctcagaacagcaccaagcgcagcattaaagagcggctcatgaagctcttgccctgctcagctgccaaaacgtcgtctcctgctattcaaaacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagtaatcctaacagcattaaaggccaaatctgtcctctttcccctgacttccttacagcatgtttatttatattacaagccattcagggacaaagaaagaaaccttgactaccccactgtctactaagaacaaacagcaagcaaaattagcaagcaaaattcactttgaaagcaccagtggttccattacattgacaactactaccaagatttagtagaaaataagtgctcaacaactaatccagattacagtatgatttagctcatcataattcagattatttttaatcatcttagccaaaactgtaaagttgccacattactaaagccacacacatcgtccctgttttgtagaaatatcacaaagaccaagaggctacagaaggaggaaatttgcaactgtctttgcaacaataaatcaggtatctattctggtgtagagataggatgttgaaagctgccctgctatcaccagtgtagaaattaagagtagtacaatacatgtacactgaaatttgccatcacgtgtttgtgtaaactcaatgtgcacattttgtatttcaaaaagaaaaaataaaagcaaaataaaatgttaaaaaaaaaaaaaaaaaaaaaa

SEQ ID NO: 492 - DNA, 2577 bp, Homo sapiens
tctgcttagtcatggtgacctgcgcgcgctccgcgcctcccccacgcgcagcgatggaggcgccggggctcgggcggtggaggcggagccggagcgcggccatggcggggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcattttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttcaccctgaaaaaaaaaaaaaa

SEQ ID NO: 493 - DNA, 1615 bp, Homo sapiens
tcagagttcacgaggcagccgaggaagaggaggcttgaggcccagggtgggcaccagccagccatggccacagccgagaccgccttgccctccatcagcacactgaccgccctgggccccttcccggacacacaggatgacttcctcaagtggtggcgctccgaagaggcgcaggacatgggcccgggtcctcctgaccccacggagccgcccctccacgtgaagtctgaggaccagcccggggaggaagaggacgatgagaggggcgcggacgccacctgggacctggatctcctcctcaccaacttctcgggcccggagcccggtggcgcgccccagacctgcgctctggcgcccagcgaggcctccggggcgcaatatccgccgccgcccgagactctgggcgcatatgctggcggcccggggctggtggctgggcttttgggttcggaggatcactcgggttgggtgcgccctgccctgcgagcccgggctcccgacgccttcgtgggcccagccctggctccagccccggcccccgagcccaaggcgctggcgctgcaaccggtgtacccggggcccggcgccggctcctcgggtggctacttcccgcggaccgggctttcagtgcctgcggcgtcgggcgccccctacgggctactgtccgggtaccccgcgatgtacccggcgcctcagtaccaagggcacttccagctcttccgcgggctccagggacccgcgcccggtcccgccacgtccccctccttcctgagttgtttgggacccgggacggtgggcactggactcggggggactgcagaggatccaggtgtgatagccgagaccgcgccatccaagcgaggccgacgttcgtgggcgcgcaagaggcaggcagcgcacacgtgcgcgcacccgggttgcggcaagagctacaccaagagctcccacctgaaggcgcatctgcgcacgcacacaggggagaagccatacgcctgcacgtgggaaggctgcggctggagattcgcgcgctcggacgagctgacccgccactaccggaaacacacggggcagcgccccttccgctgccagctctgcccacgtgctttttcgcgctctgaccacctggccttgcacatgaagcgccacctttgagccctgccctggcacttggactctcctagtgactggggatgggacaagaagcctgtttggtggtctcttcacacggacgcgcgtgacacaatgctgggtggttttcccacgaatggaccctctcctggactcgcgttcccaaagatccacccaaatatcaaacacggacccatagacagccctgggggagcctcttacggaaaatccgacaagccttcagccacagggagccacacagagatgtccaaactgtcgtgcaaacccagtgagacagaccgccaaataaacggactcagtggacactcagaccagctcccagatggccctggacagcaggagagggtgtgggatgaggcttcccagagaccctgggtctagaaagcggctcctgaaggtcccttattgtggctgatattaactgtcaatggttatgggtcctataaaaatgcccctcccagataaa

SEQ ID NO: 494 - DNA, 10923 bp, Homo sapiens
attcatttcctgagaactgcagagagccgctgagaggctctgcgtgtgcgtgtgcgcgggtgacgccgtgtgtgtgcgagtgtgtgtgtgtgtgtgcgcgcgcgcgtgtgagagagagaaagggagagagagagggggactctgtgtgagggaaagaaaacaatttctcctgctctgcagcttctgttcaggatcaatgtgactctaagaacaaatggatgaatgaatatccatatgaagagaaaaacaataaagaatatcaacacctttgagaacagaatgttaatgcttgatgggatgccggcagtcagagtcaaaacagagcttttggaatctgaacaagggtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccagaaaacggcgtatccacagatgtgattttgagggatgcaacaaagtgtacacaaaaagttctcacctgaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtgaggaatgctacctgtccagctgagcgtaagagctggatctcttagcggcacccaattcagcagggctgaatccccttcacagtgttaacacaaaagggcatcaccatcccacgatgtctgaaaccagagcaggaaaaagaaggcacacttcttttggtctgaaggtaacccccatcatgactagacgagaaccgtctttacccgggcctgggagctcagtgacataaatgctgaagagacaggcattgttttccgtgctgtgtcctctgccatttaaagatgtttgtagcttgtacattttctgagctgtcagacattttgttattgataccttaaaggtcacctaccacaaattgatggctagagcaagaccttttaaatttggatgaatctcccatcatcccatcccttaacccctttttacagaaattttagttacaatctgagtaagctagaacacacatccaatctgttaccagcaagcagcatgaaagtagaaacgaagaagcagatggagaggtcccattacctgcaaagaaagggcactcaggcagccctttgcaatcgcgatggcagccactagatatcactctcaacttgtcattctgccatgccctgaagaaaaccaacattgaatctttcatttgtttgtcgttgattgtttttgttttgtttcgattctgttttgttcatctgttcgagcagaggggcagttgaagtctcgtcctggtctctgccctggcatggactggcacagaggtgttctgtagttgaataggaagagcctgtctaaaaaactactgccccacttcaaattgcagtgttctgtcacctaggcatcatctcttcctgcccctagtatttgattacaaggaaccaggggaaaaaaactttcttagacacactggcaccaaggtaagaggtggggctgcccaggcaaagtcagtgaacatgaaaactcagacaaagcagagatggaaataatgcgcctcttgaggagaaaagcaataatgaataaaaggactttcctacaataacttcactgaggactcacgttaccaattttcatacttactaaagggattgtaaaaaacaccccagcattttaggtgtcttggttccatttacagcactgaggtaatctttctgctgtttgttgtcctgcttggttgagtaccacaattaaagattatgctccccttttcttgtttgaaaacagttatttggtgactagaaaggcaagggaggcatagccgggaattaactcttcggttaatgggtcagttctccttggaactgaatcagtggaaagagaatgcttcccatagaaagcccgacatggtgctagtttcctctcttggagagccaaggataagtgactctccaataggttcttctataccgatttcattttctaaactgtatcaggacccaggtgtcctgcattggcatctgcagggatattgaacccactcatcctgtgcagaggatgagaggaaggtgttagttccatcagccccataaaattatgaacctttttgcaactaggaacatatacagtaaacaagcaatacatcaccaacgagcattctttcagaaaaattaccatatttttgtccccaccacaagctgggtttttttccagctttctgtggctgaggggctggtgagattttttgttgttattgttgttgttgctagaattttttatagcttagatataaaaggtctccaacaaagacctttgcaatatattttaattacaaacacttgattttgggaattgcacatattaacctcacaatattactagctcatttttaaatgtctggacattctgaaataatttccggttacagaattaccctttttaggatcatcttctaattcagataatcttattctgatgaagcgagaactatgaacgttgaaacaaggacaatttgtgttggatggtattcaaaaggaattttttaaaacattaagcaacagtgtaatgattttcaggtcaaattatggcttcacaaatatgtgctctatattgtctgccaggtctcaaaaattcatcaagcaatttccctccaacaagggctgcagttctagtgataaatagcatctttagctgcacagtctactactcatcaaccagtgggttttttttagcacctggaaagtttttttgtactatatgcaactcctacttcacattgcctgtgaccattcagaatagaaaaaggtctgttgatgcatgccagtgctggttactagtcagtgacagagaacacagagagggacaaacacagccatgaaccccctggcactagtaccagcacctagttggcaagtagtgggtgcatctctcaagtgaagtgtagatttgtatttagtcctgcttgctctcataaaaagagccagttcttttctctgctgaaagatgtcttgagagtattacaggtagacttggtttttagaattcataaaactgacaggcaggggaatcttcctgagtgacagcttggtttaaatttagcacagaactagatgagttgcacttttctaataacataggatggatttggggaagggaacattttccctcatcctctgaaagtggaaaccagactgagatggtaagttaactgataaaacctgtcagcattccatcattttccccttttgacgtatcagtacttctaagaagggatctaagcacaattaagtgaattgagtccctggtctagcctcaggaactgaaacttctttggggcttgtcttgagacgtggcaaattctccttggtgagttttctaaaagtatttccccatggaaaggagaaagtggtttgggacagaaagaaatggaatgtcttcagtcatggaagagcctccatttcatctcatgtccatttctagcctctttcaaaaagcacagtgcatcatgagcaacagaaaagcagtagaatcctaaaggacataacagttgttccgtaactagaagcattctttgattttaaatttgaagctgttcagtttgcagctggggatatgtgcatggttgggaacttatacacatagagccattaactacttaagcagctgcagtagacctgattttctgtttgcagtatagagattgatttcaagggagttacattatttgaaaagttatgactttcagcctttgaggttttaagaatcccttttcatggtctgatcttaagttgtttgaaaaaagattcacgcttctgcatccacctctgccctcattctgtcaattgtgtgtggactctgagaagcctgcttgataacttgtcttaagttctattaaggcagttagactgagatttctaatgacttcaccataaagattatacttctgcctggcgtcgtttctataaaacactataggacatttgttttcaaaagcagttgagtaacagcaacataaaccacattttttaaaaaaatgagcacttttcattcacttgaaagcttaagtgggaaaaaggaagatgattgtcaggggaaaaacttacaaaatgctacagtgtttacaaatgccagttccaggtgattagaaaggccgttttcattatggttcagatttggaatagcttatgcaaagattgtgttcatttttatacaattctttttaactttaaattgccatctgtgttttaaacataattctgcactttggaatcagttcattagaatgataacatttatatggataaagatgcagtattccttattctgtacttgatttattatacttaccaaagctgcaactgaataaatctggtgaggtgaggccttcaaaatgtattaatacgcctttgttatgttgttatgactgcttagaaatgtagccatgatgttgttctaaagatgtcttaacatttatagtgaggattgacagaaattaagcagtgttaagaataccagcatccatgttacagtctgcgtataagggactgaatgtgaggtaactcttatgaatcataataggcccagaaagccttaatattcatagttcataatccagtctcagattttgctcttcaatgttgcctgtaaacttagcaggtaaatgtattctagtataaaacatcattgaccaaatctcttcctttagtttttctgaggtagtgcatcccattaaaaaagtctcttcaattagatttggctttagtttagaaaggggtttggtaagtcatgtcttccatatgacatttctactcatccccacactgccttccacttaacctgtacagacagccccaacacatgcacatgtgtgtacacaactgtatatgcagcagccagtgggctaacaaatatcagcaaagaacttttttaaaaagaatttgtaataatccgtgctgtctagaaatgtgagttacttaccttattaggaaaccggcttataatactatatatgactctgcctgcattttatagttaagaaatgtacataaaaattgctatattttcacagtttcattataatgtctgtttagtaacccatgtccactgatactttaaatatgctaattactgagcaattgcaatagaaatccagattttcataagaaaatgaaatagaaggatactgcatctttaaaaaatagagtgaagatattttactgtattcgtaacatatgtgatagtggaaaaagtattttcaaactcacaaattttacagaggttgtaaatagtttgatgaagtatgttgggaaagagagcttctagttttcatcacaataaaaagaaaaaacttgttcagatatgccttgtatatcttacacacaatgagtgaaattgccatgggaactctgtccaactttgtcagagcatgctcttcgtgttctgttcaaaatagagtggccacttgtcatggtttagccaggatggtttaaaatataatgaagtcattttaagttgcagacaactgattccaaactagtaatgtcttttcctgaaaagggcaaaacagctgcacaggattttgcttgtactaaagaggagcatcttacaattgttctcttttctcagttatctccctcctcaacagagtgtgaacaaccatacaggtgtttattcttgttttattccagggagactgcttttaggtataactacatgttgacaagattaagtgctgtggatatggccacgtgttaaaggaatctatactcgcaataggaataagctaatgcccattttcagaaataaattaaatgctgaaagtgcctgtcagtaaaccttatgaccaatgagatattcctatacttttacacagcaataattcttaataagactgggttttttcctgcacatgtgaacacacacacacatacacacagagagagtaaatacatacacatagtaaatcaaatctgttcacatgcccacaaaaaacgcttttatagctttcaaatatacctaatcttgtttacattaacatttcttaatttgatctttctaacttgcagaacgttaagaacacaaatctgaacattaagtttatcttcagtgaacactattgcatatggtaattataatttccagataaaaagttgactgtcatttgccccaaacttatgaaacagtatgtatgattcaaaaagttttgctcagttaaaaacaccaatttatttggcgcaaaagactgaaggatatttgtttgcttgttcattttatccactcatatcaaacgcacaaattcatctttacatttcttcattcccctttcccctaatatttcctattatcatcttaagaatcattttggaatgaatattgacagaatcatttctccccaaaaagtctgttgaagtaccactgacacttagtaagcctagcctttaaccatctttgcagttagtcctaaaaattaccagatgcacattcagaagctcacaggttttttcctgtaattactgtactgctaaaagtggagtcatggatagaaatatacaatgagactatatgaatagacatgaaccctggaaattctccaaccctgccatctcagagcacaaattcacccaaacaagctactgaggctatcagtaaaattatactcatggagagtcacacatcgggtaagggcaattttaaaagtaggactgtgattaaacattcaggctttagacttccatgatggactcagaccacaggcctcaaaaaaacatccactgttttctcctcccaatgttagaaagaagaaaagggagacggaaatgtaccaggataagggggtaaaataaccaattaagtgtcaaaggaaagctgctgggttccttaatctcactgaagtcaagtcttctgactgggcttcttaccatgtgttgtctgaaaaaactaaagtaccttgaaaggttacacattcagcaaaccatgaagataatagctattctttattaaacactgtgtgccaagcaatagactaggcaatttttagatacgttacctgcaacctgtacaacatttctacactttatggatgggaaacggagacatgggaagtgtggctgagttgttcatggatgtagaaatagtaaacggcagagtaggaaagtgaaaccgcctatctctgacctggaggtctgcctgtatctttcccactccaccacactgcacgtgggtgtcccgaaaccaccttcccagattcctgactctcagtaattttattatggacaacatgcatgagtagtcatcatatttttcaagtgaaatatcgggacatgatataacacatgacttaacaatggtactgaatatttgaaatcaggcctttcccggaaaatcatgcatgaaggatcattataaacaaacaatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcatttctcatagtgtttctgtttctgaaaatgaatctcctgaattattatctttctccctgttacttggctggggaaagagatagaagctgtataaacaaattctcttccatgctcaaagcaagtgttccatgtgcacaacctgctgcagactggggcccttctcagttaattgggtttcacaagcaataatttctccacaacaaaaaccacaacttgaagtgagttgaaaagagatcaatagtggaaacagtcgcctcagtactttttctttctggatttcatctctagaaatttgaagtgtttgagacagagtccaccctttgtgcaaggcgagaaccaatgaatggactccttgtgtgaattattgcatcttcttccaaagcaggttcatcaagactttcacagagattcatttttgttgagaagtaagggttaataggaggatagaatttggatccaaatctagtgataaaagtgtccaagcaatcaaaaagtaagatattttagggacataccaacatcttccctttctgctaatttcatgctccaaagatatggcaaaaaaaaaaatcataaaaagtgcttttgccctacttgtgttctagttttcccatggcagaattttgtaattacatccagaatatagtgtatattttgttcctcaaactttattacattggatggatattgttgaactggggcactggtgcctatattcaaggctctttcctatcaacgtgtctgtccacgatttgttgtgtttaaagcttcattttgaaaaatcactgtccccctgtggggtagtgactgtattgttttgttcatgtctatgtgggacacattgcatcacatggcaaaccaactctctgtggatgtgagataagtacttataaaaccagcttgaaaacatcgtcttatgtattatgtcatcctgcatcataatgcaattatgtgtatcataacatgctcatttaaaaaaagagaaaccagcaaattcatgtttgtccatagaagaatgtactcagaactttgtgttgtgaaacgatgagaacagaccacctttaagatacccacctgccacttaaaatgacttagttataattagtagtagtctagacgttgttcttggtgtgtgggggtcaattctaacgtcatgttcttttgaataaatctctcagtcatatttgaaaaaaaaatacatgggaataaagaaaaatatcatctttggccaaatcaagcaggcatcttttttcttttccttgacgtttagctcattatacgtggtgattggatcacgagatctgtccgtgtgaaaatacagaaacatcctttagtttacaaaacagttattctaggcttgaagcctctgaacagcaaattgaatagatgggctgcatctgatttgctttatggatgtaattttacaaaacactcttgggtctctgaccccagggagttaagagtgcccagaggaggtcctacacattaaaggataaagccccccagtgatgctggcaagcaaatgtgttgagttcttaaatcttcatttggttttctgttcaggattttaattgcaaatgaatttatttctccagtttatctaaagacctaatttcccaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaactccctaactgactcagacactttggaaatcatagttattaaccattctaattaaacctttgttatgaaaagttttaaaaaaaaaaaaaaa

SEQ ID NO: 495 - DNA, 6817 bp, Homo sapiens
gcgcggcgaagctgcggccgcgacttggcgaggtggtccctaacgttgccgctcggcatccttagaaccggccgcccctgacgccgcgcggggaccccagtcgcccgcgcgccccatgcgctcactcttcggtgcccggccgggccggcgcctcgcagacgcggagccgcgcgggtgacggcacaggcggctgcgcgcccagcccagcccagcccagcccgaggagagggcgcgccgcgcccccgccccccgcccgctctcccgaggccgtgggtgcggatgcgcggctgacgactcgcagcaagagcaccgccgccggccccagcccgcagcatggcagccgccgcctatgtggaccacttcgccgccgagtgcctcgtgtccatgtcgagccgcgcggtcgtgcacgggccgcgggaggggccggagtcccggcccgagggcgcggccgtggccgccacccccacgctgccccgcgtcgaggagcgccgcgacggtaaggacagcgcctcgctcttcgtggtggcgcggatcctagcggacctcaaccagcaagcgccggcgcccgccccggcggagcgcagggagggcgccgcggcccggaaggcgaggaccccctgccgcctgccgccgcccgcccccgagcccacctcccccggcgccgaaggcgcggcggccgcgccccccagcccggcgtggagcgagccggagcccgaggcggggctggagcccgagcgggagccggggcccgcggggagcggcgagcccggcctcagacaaagggtccggcggggccgaagtcgcgccgacctcgagtccccgcagaggaagcacaagtgccactacgcgggctgcgagaaagtttacgggaaatcttcgcacctcaaggcgcacctgagaactcacacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaacaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcagcgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcatgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatctggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggagagaagtagcgtcccctaccctacaagtcacacattccggggaggggggtggggggtggaggcaggaagtcatgggggtgggggtgggagcacgggaacagctttcttaaggcctcagggtcctgttttccctggcctcttctagagggcccgtggacaggtcgcagtgcgtgcttatttggaaaccaggtgtgtgagccgaatgcctgccaggccatgcactcagcagaggagcccttgtacctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattattttaaaaaaaaaaaaaaaaaa

SEQ ID NO: 496 - DNA, 1509 bp, Homo sapiens
cgctcgccggcggccgggcggtcccagcatgtcggccgccgtggcgtgcctggactacttcgccgccgagtgcctggtgtccatgtccgcgggcgccgtggttcaccgccgcccgccggaccccgagggcgcgggtggagccgcaggctcggaggtgggtgcggcgcatccggagtccgctctgccgggtccggggccatcggggcccgcgtcggtcccccagctcccgcaggtccccgcccccagccccggcgcgggcggcgccgcgccccacctgctggctgcaagcgtctgggcggacttgcgcggcagctctggcgagggctcctgggagaactcgggggaagctccacgcgcctcgtccggcttctccgacccgatcccgtgctccgtccagaccccgtgctccgagctggctcccgcctccggcgccgcggcggtctgcgctcccgagagctcctccgatgcgcccgccgtcccaagcgcgcctgctgccccgggcgcaccagcagcctctggtgggttctctggaggggccctaggggcaggccccgcccccgccgcggatcaggcgccccggaggaggtctgtcacacctgctgccaagcgccaccaatgccccttcccgggctgcaccaaagcctattacaagtcgtcgcacctcaagtcccaccagcgcacccacacgggtgagcgccctttctcctgcgactggctcgactgcgacaagaagtttacgcgttccgacgagctggcccgccactacaggacgcacacgggcgagaagcgcttctcctgccccctctgccccaagcagttctcccggagcgaccacctgaccaagcatgctcgccgccacccaacctatcatccagatatgatcgagtaccggggacgtcgtcgaactccccgcatcgacccgccactcaccagcgaggtggaaagctccgcctccggctccggtcccggcccggcgcccagcttcaccacctgcctgtaggacagtcattgctgtcagtcttaccctcaaggatgatcccccaggccgttgtccctgctttctctctgcccatccttctttcccagagtcattacaccaaggcacagactggttcctctgctctgagggtgggtccaggcagacatgtggactctggggaggtactgggggccggaaaatagcgggaattcttgcaacgtgtatatcatcctaaaagtgggggttgcctcaagacagcccccaggaactgataagaagggatgaactcccgtactctccagagtactgaagattctcccctccctggaaccagggatgtgaaactggaattctcagatgcctgaggagctcccagtctcaaaggactctggtgtctcacccatccaccaggcggaccttggagagggtgtcaggggtggcagtcttggaaatgtccaggactgggatggtgagaggcctttggaaacagaaatgatttctatttctgtaaacaaaaaaaaaaaaaaaaa

SEQ ID NO: 497 - DNA, 2539 bp, Homo sapiens
cgacccgcgggccggcgggcgatcgagccagcgcaggacccgcggctcggcccccggccgccgccggaccgagagtctagccgccgcccccagcccagcccgcccggccgcaggaccgccggggcctggccgccggtccggcgtgcgccaagttcagccgccaccggcacggccaggccagcatggtggaccacttacttccagtggacgagaacttctcgtcgccaaaatgcccagttgggtatctgggtgataggctggttggccggcgggcatatcacatgctgccctcacccgtctctgaagatgacagcgatgcctccagcccctgctcctgttccagtcccgactctcaagccctctgctcctgctatggtggaggcctgggcaccgagagccaggacagcatcttggacttcctattgtcccaggccacgctgggcagtggcgggggcagcggcagtagcattggggccagcagtggccccgtggcctgggggccctggcgaagggcagcggcccctgtgaagggggagcatttctgcttgcccgagtttcctttgggtgatcctgatgacgtcccacggcccttccagcctaccctggaggagattgaagagtttctggaggagaacatggagcctggagtcaaggaggtccctgagggcaacagcaaggacttggatgcctgcagccagctctcagctgggccacacaagagccacctccatcctgggtccagcgggagagagcgctgttcccctccaccaggtggtgccagtgcaggaggtgcccagggcccaggtgggggccccacgcctgatggccccatcccagtgttgctgcagatccagcccgtgcctgtgaagcaggaatcgggcacagggcctgcctcccctgggcaagccccagagaatgtcaaggttgcccagctcctggtcaacatccaggggcagaccttcgcactcgtgccccaggtggtaccctcctccaacttgaacctgccctccaagtttgtgcgcattgcccctgtgcccattgccgccaagcctgttggatcgggacccctggggcctggccctgccggtctcctcatgggccagaagttccccaagaacccagccgcagaactcatcaaaatgcacaaatgtactttccctggctgcagcaagatgtacaccaaaagcagccacctcaaggcccacctgcgccggcacacgggtgagaagcccttcgcctgcacctggccaggctgcggctggaggttctcgcgctctgacgagctgtcgcggcacaggcgctcgcactcaggtgtgaagccgtaccagtgtcctgtgtgcgagaagaagttcgcgcggagcgaccacctctccaagcacatcaaggtgcaccgcttcccgcggagcagccgctccgtgcgctccgtgaactgaaagcgccctgaaccccagcctgtccgtcaccccggatccccaccccatccccatttttttaagcaataatttatttgcctcctccagagggacatggcaatgttaccagcccaccttctgaagcctgggaggtgtgaacccagggcccgccaaccgctgcctttctcgggagtacttagagcctcgaacccgcgtccctgggggctgggccccaggcgcacggggctggaggcaggccttcgtgccttcgtgccttcgtgccttcccgcggtggccaggcctctgctgcagccgctggttgcaggcagagttttggggacctggcccttctcccactgggctcccccatcctgggccaaggccagaactttagtgctaggggaagatgaaatgtgcagttttgaaatgttgggtttccagagagagtcatgctggaggagaaggaagtaggccagaagtccagggctgcactgtggtgtgagggtggctttgtctaagatgcctgctcagcatgatcaccagagggtgtgggcaggtccctggagccgggggggggggggggggggggggggggcaggaccgggccgctgggccctcatgtgggagagaggtgaaaagcgtcccccactagggggctggcagtgcatgtgcttgagttaaatgtgcagggcagacagagccagaagggcctgtacccaggggctcgtcccctcctccggtttcccagacaaatccagacaccagcctttagggtggccttgggaggagagggccaggctgtcctgggtgtgagagaactagatagagcctcccaaccctgatttagaaatgcattccttattttgtctagaaattaataaatgaactagcttgttttgacaggtttatttcacatcctatgaatgtatgtaaataaactgtacataggtccatccacataaaatatcttttaataacatatcaacatttgtgtaaatttgaaatttaaaaaaatctatgaagctggtgtacatatgttacaattacgtatattttctttggtccttcataaaaatatatttactttgccaataaaaagaaaaagaactcacaaaaaaaaaaaaaaa

SEQ ID NO: 498 - DNA, 2904 bp, Homo sapiens
cgccggccggacggacgccgctcccgccgcctccgctccgcccgccgcgccgcgcgcccttgctcggcatgtcggcggccgtggcgtgcgtggattacttcgccgccgacgtgctcatggccatctcttcgggcgccgtggtgcaccgcgggcggcccggccccgagggcgcgggccccgccgccggcctggatgtgcgcgcggcgcgccgcgaggccgcctcacccgggaccccggggccacccccgccgccccccgccgcttctggcccgggccccggcgccgccgcggcgccccacctgctggccgccagcatcctggccgacctgcgcggcggacccggagccgccccggggggcgcctcgcccgcctcctcctcctcagccgcctcgtccccgtcctcgggccgcgcccccggcgccgcgccctccgccgccgccaagagccaccgctgtcccttcccggactgcgccaaagcctactacaagtcctcgcacctaaagtcgcacctgcggacgcacacaggggaacgcccttttgcttgtgactggcagggctgcgacaagaagttcgcccgctccgacgagctggcccgccaccaccggacgcacacgggcgagaagcgcttctcctgccctctgtgctccaagcgcttcacccgcagtgaccacctggccaagcacgcccgccgccaccccggcttccacccggacctgctccggcgccctggtgcccgcagtacctcccccagcgactcgctgccctgcagcctggccgggagccctgcgcccagccccgcgcccagcccagcccccgcaggcctgtagggccctcgtgcagcccaccctgaccgccaggatgcttctgccatccaggggtgtagtgaggacccacggggagcctgggccccttccagccgtgggcaaaccctgaagacacccctgcccccctccagagagtgaggagggggcctgagactggacctgggtctgcctgacctcagaggtggctctcaggatgggtgacgggggcttgtgtctgtaaatagccatgatactaactttcttcccatctgtgcaacggggcccccccagggcagctaggaggtcctcccctctcctctccaccaccccctgctgcccccctcccggggtggggtttgggggggtggagtggacttctgggagccggcccggggaaagcaccccctgccccatccctgcagattgggatgaagtgttcagacagccatagaggagtcgggggttgacacggcccctgcctctccccaccccacccccaccccaccgaaagccatgggagtagttcagggaaatgggggtgcagcccagccaccccccattcgggtactcaatctcaggtgtccacaagttctgcccacggtaggggctgcctggccccccagacctcgggggtagagccaggagtggggcagcgttaggatgcccggaggggctccaggtgttgcttctgagacctgggatggggagggaggggacctctgggttcttccaaagaacatttgactcagtggggtcgggagggaatcctggcttatttattttcctctgtcctcgggtgtgggggccctagctcgccctctctgggtgggtgggtgagagaggctgcaggggaggctggcaccgggcttgggcctccagtccctgccttgctgactttggccgttgcggtatcacgtgacaatcaactctcccttaacgacgactgcggctgttgggctgcgctgccctccctggcctgcaggtggggccgtggagcccatgcccgccggggttgcaggctcttccgggcctgggctgcagcctggcccggccctgcttccctggcctcccctccttctcctgggtgcttggaagaggtgggtcctggcccgtggttgaggtcttgcctcgtggactggaagcagagggctggctgtgcagcctcctggggtagctcgttttttttgcaccgggtagaatattttttcaggcacggattcctttttttctgggcccccatgggtggtccggcatcctcagggggtgtgagtgtgtgtggggggtctctgagctgaacttgggtggggtggggacttgttcctcgggggccacctttgtgtccttgtcagcggtcgtcctgctgtggcctgggttgcatttcctcttggggggggtattgaggacccccagcctggaatgagaagggtccccggttccatgtcagacccagaaaggtggatccccccactgttggctgcaggaggtttttggtacccccttttgttccagaaccgtcctgcctctcgcttggggacaggggggctttggatggcactggtgtgcacctggacccagccccggcctggcaggatccagggatgggtgcctgggatcctggggggagggaggcaggggacgcccttctggagctgggctcggagggtcctgccccatccagccctcggctctctgtgttctctgtccctagcctcaaaccctcttctggcagcgctagtgagatgccttagtctgtgggggtgggtgggggactggggccccgttttcctttgtgagtcttggttggccccagccctggcaggggcctgtctggagcaggggtaggtagggctgtgggttccagaactctataactgggcccctctccagtgtccaggggcttggagagacctgcgcccacccctccactctcccaggagtcgctgatcactgggacctggttccagccgtttgcaggggaggcggctccgagaggcgtgtgctttccgtgggtggcgcccctcccccgccctgcctggcctcatccttgtatttaattaattaaacaagcccctttttaaaccctaaaaaaaaaaaaaaaaaa

SEQ ID NO: 499 - DNA, 1655 bp, Homo sapiens
gcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgacgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaa

SEQ ID NO: 500 - DNA, 5632 bp, Homo sapiens
tacttaccccgccagccccgggaggctcgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatccaaaacttccatatggtcagtagtagatgttctctaatcctccctctccttaccacgggtcagacctaaagaatgtgaacacttttttttttttttctggggatgctaagcaaacccttcttacagatacgtttaatgtaataagaacaagggaacatgtaaactaacataaccaattgtcagttctccatgtattcctcaaaagaatgtcagagtaaatgtattagaaatacagtatccagactgctagtccttgccagagacattcttacctctgccctgtgataatattttatgcttgacagtgaaaacaagtgtggccccttgcaccggttagctagaagtacagccagatttcaagctagtgcagtcacctcttccgtcattcttcacaaatcttgtcaacctggatcttagacttcatctgaatcgagttctttgccctcctttgtgcctgcagctcatatggaggtctttgccaccaatgggagatgagcccaaactttcgatctaggtgggtgatgtgtagcagttcaagggaagggtgctgtgttttcatagcatggagtcggaggagagggccatttagcagggggagcagaagaggcaattcctcctgggctaggggttgtcagtgaggtttcaacattttgttagctgtgtgcagcattcccagagcttcagtctctgtgcatactcagctttgtagaaccatgctgcaaagccatataccgatggggttatccatgcaactatctccattcctacaatgtccttaatatgagatcatcaaacattgatagtagggactccatggaatatttgcccagtaatggtaagaaatctttcgggtaagagtatggatggttcttcttttacccaatctgcttatagctttttttgtaaacagggaaatgttgagtggtacttgtattcccttatcaaattaatcacatagcttttatacagaaactcttcctgtgtgagctgttaaggtgccaaattggctgtcatttgtattcatgacacataccataaagcatctgctaatgctttaatggattgattcaattaagacctgagtgacactatttgtaaatataactagttgtgaagcacacatacctttattttgggaatttatgagaaaatatagaaaaccacagatcagggattcatatatgtagctcaaaaattcccaaaagtttactgttagagttggcaatttcctatcactatttcagtgtcagaacaaactgaaaataatggctcgtgtttatgttgaagataaatagcaccattattgggggaagttattcaaaagcaggcttttgagcaccatagtctaaatgccaataaaaataattcatacatagaaatgtcattggtcctgaatttgaagaaagtgagcaacagtagttaaatgtgggtgcatataaccaaattccccttcatcaagaatggaggagaagagagaagaatgaaatcctgaagattcatcccagccgcaactcaggatccaacacaactttaactgggaggaatacattgtttgatcatttttaaaacatctgtgaatgagtgattccggaggcctgtgaattgtgtggggagcttgctttgatggcactgtgttaataaaagttgtagggactgtgcacctaagaggctaagaggtcccactcatccgccctgtgaaccagctgtaaagaaatgtagttaagaaatgcaaagaaatgtgttatcttggcacttgggtttgattttcctttttttaaagcactgcaaaacttctttaggatactaaaacatcctaattgggctgtttttttgttttgttttgtttttcagctaaaggcaaagataatttttttttcagctgaagtttttcttttttgcaactatgacatgaattgagtgataaaatggctctttgaaaagtagatattgtctgtattgtaaatgcttagtcatattcatggcaaagtgttcatttcttgagatggttctttcacaacacacaagaatcaagatggaacgcaaggaaaatctttttgttttgaccgaggtaaccagtttatgtgtgttccaatccatagagaagtgggggaaagggcgagaaaggatcagattgatctgggatcagctttgagcctgagttcagtgaatagcctcatgggcatctcatggaattgatgcatttgctgtggcatatttaaattttgttcaaaagatttgaagcaagaccttgcaaagactcttaacattactgttcagcttgcttagattgtgttaacagttcatttaacaaagatccgttttaactctgaacaaaagcaacccagagcggccattctctattcccatgctggtcaatacgctttcattaccaattggcccttaccaaacttttcttatatatatatttgtattttactatgatagttgagaaatttagcctcttagtcatttttagctgttattgtggaagacctcaaatacaagattagatgcccttgaacatgttttaatgatgtgtgtcatgttactatcaatggtgatttcaatcgcaatattttaaattgatgagaatgatttgtaaacatgaagttactattacgtaaattctgtttgttatagagtttcttcagttgttacccaagtgtcatcctagagaagtcagaagaatcagaatccatcgtattttagagttatgtgaatctacatcataaatgggcattaacattctaaattgcttggtttggagaatgtgttagcagcatagctatattcaactagggagatgctaaatacacagaagtttcaagagccttggaacagaattacaggggaactatatatgtatatgtatattttattaaacacccatctgcactatcagtattgcactaatgtggaatttgaaagactattttgctgatactgtatatatgcgcatcattcctgattagattgttgtaaagacaatctgaaagatctaaggttttaaaataatttggtttgaaaatatacagttgtcttgaaggaattgctgtcatacatgaagttgctccgagctgtctttattctcttcttggtcaaggttaacaattgctaaatgatcgcaaattcacctaaacaatacatttacaaagccatctttacatgcattaaacgagggctacaacaatattgttttacaaatactagcacttttttttctgttatgtacttagtgttagagggtcaaaataatctttctgcttagcatctcttaaaccatacctgcaaatatagcaggattattacatttacagtactttaatacttgtataaactatgcagaaatttttaataaagtgtaatatattttataagctaataagactgaatgggtaaaggtttttagcatgcattagtatacttgcagatactgaaacattttggtaatctttcttactaaagatgtgaatgtttaatgtaccttctctgtttctactctgtagtccaatgggaattcagtaatgacattttgtcatgtcaaactgtgaacataaatttgtactgtacagtcctcatatactatatacagtatgcaatatatattatatacttgttaataaaaccatcagaatattaaatgtgatcatgtgattacttcatatgcagtgatcactagagcaaaacttacagagcaatgtaagaacccttgcttagaacattacttactctgatgggcagttattgttgatggagggacagaaaaatagatctaactggaagatgaactaccggaattaactcagccctcaagctatgtccctggttttctgaaaacagccaacaggaagtctcctaggctgaaatcataaaactgcagacaatccagcaaaaatctacaaactcacctagttcattcttgaaatacttcttgtatttgttatttatgaacccctgcctgcttccaaaaagaacttgcagcattttgtattaaaagacgcatgtgtataatactttaaacttttagagtaaaatatcaagactctcatgttggggagtggggaacgaggaacagaacaataacgcattaaagtaaataactctggaaaaaaaaaaaaaaaaaa

SEQ ID NO: 501 - DNA, 2949 bp, Homo sapiens
agtttcccgaccagagagaacgaacgtgtctgcgggcgcgcggggagcagaggcggtggcgggcggcggcggcaccgggagccgccgagtgaccctcccccgcccctctggccccccaccctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaaaaaaaaaaaa

SEQ ID NO: 502 - DNA, 3350 bp, Homo sapiens
tagtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaacaaaagcaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaaga

SEQ ID NO: 503 - DNA, 1639 bp, Homo sapiens
gatccacgagctggagtgattagagccctggaagggaattgttactcccgtggagaagtccccttttcctggcagtcgtctgcactgtacacgctggatgcctctctccatccaccccactcactcgctcctctctcacctcctctctccctctcctgcattgatttttttttttcctttttagttgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctaggggctgaagcatgtcccgaaaacaagaagagggttcaccgctgtcagtttaacgggtgccggaaagtttatacaaaaagctcccacttaaaggcccaccagaggactcacacaggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagctctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcac

SEQ ID NO: 504 - DNA, 5434 bp, Homo sapiens
ttttaaggaactccaccctaggtggagtcctcacgatagtcacacctctcctttgggcctagcagggccagagaaagacggaatcactctacccactcaggttgcccagagagcactttaggttctgactcgcgtggggcgcgaggtaccccgtggggcagctaggtgcctccaagaaaccccgccccagaggacccgcacgagttgctgccatttttcgctgaagcccctgccctggggctggtgttcttctctatgattctaccaatcgtcggcatttttttcctcccttctttctttttaggaaggcgctggggtgtgcggcggcaacggcggcggtgaagggatcctcttgtggtatctcctcgtgggttcctgtcttgaaggatttcttctccgcctcaactttatgttcaagtagcgctttgggggttgggttggttttcatagcccccacccccggccctctccttttaaagggtgtgtggagttcagaggatgggtggagagcgggcttggccggaactgaattggtagaggtaaaaggggaacggaggaccttaagctctggccacttcggcccagcgaacccactttatttttgtccaaggaaaagctgcaggggggaggattctttttaggaagtctactctgccggcccctgatttttgggttggatgcttgagagctttgtttcccttgttccgagagtggcccagctgggtctgaatcgactccctcccctttcgaccccctcctcattttccagcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcgatatggataaactcataaacaacttggaggtccaacttaattcagaaggtggctcaatgcaggtattcaagcaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcagtgaaagttgaccccacctccatgtctccactggaaattccaagtgacagtgaggagagtacaattgagagtggatcctcagccttgcagagtctgcagggactacagcaagaaccagcagcaatggcccaaatgcagggagaagagtcgcttgacttgaagagaagacggattcaccaatgtgactttgcaggatgcagcaaagtgtacaccaaaagctctcacctgaaagctcaccgcagaatccatacaggagagaagccttataaatgcacctgggatggctgctcctggaaatttgctcgctcagatgagctcactcgccatttccgcaagcacacaggcatcaagccttttcggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctcccgtggggctcttcatattctaccttcacttctccactgtccagacccgtttttttcaacctccacatgggttgaattccagtgtggcacccatggctgccttcccatccccccctgctctgaaataggacatttttcctacagtaacaaaacaggaatcaaactcaaggctgtgaacaaacatacgctgctttattctttccaatttttctcttgttttctagaactcttatccatatgtttttaaaataagtacctaaaagtggtttgatagtgtcctaaacgacttttttaacttcctaaatggaaagagcataacaatgtagttgattggtaagatttacagggatttggtttctgagtttgaggcacattcccagtgaataagctgagtcccataccacactcaaaaggttttaataaatctaatcctatttcttcttaaagtttggttttcagacagtgctggtgcttctgcttcttaagttcatcaagggaatgaggagttcttgtccttctcctcctcttttttttcttttccactttctccttcaggattaaagattttgctgcacaattgttatttgttaggttaaatttggacaaatattcaaagcacacatagacatataagtaaggagaaaaatgttccaggagagtaggttgggcagtgacaggaacaaacagacctaggatgatcctgagaacaaatagaggggttcctttacttgtataggatatcaaaagtgctgttaatcacaaacctcattcaaatggcaggctgtcgagacagtgtcttgaggggctggctgtactgtttattttttcgtttacacaaagaagcaattgagtatattgcatgatgagaaatcacacactagggtcatgttatacagaagtaaggggttggaaaaatggaatgttgttcactccatggaattattggcattcattcctgtgtttcaaatgaaacatagatgcttttcatgaaaactgacctacaaaaagcaatttgatgttctgcaactgctatgaaaacctaagccatttattttagctgatagcagattgcataatatactcatttagctgcccaatcagattgttttataatattacctggggtacaaaatcctctgttcctggccctggaccacagatctacctccacatggcatatttcctttctggggtcaggggtaggggagggggctttgcatcacttgaatttagactcagcctctctttaaaagattgtctttatattgaacacctttttcttttcaaccctgcttgaatactttaggttactatttcctgaggctgtccattctcactatattgtagaattctagcaccaagaagggatcccgttaaccatctagtcctatccatccctcatattttacagatgagacaaatacgggtcagatttttttctccagatgtttctttgagcccttatacacctgcacgcttattctcctggggatcacataattttatttatttattttttgagagacggtttcactccatcacccaggctggagtgcagtggcgtaatcttggctcactgcaacctccgcctcctgggttcaagtgattctcctgcctcagcctcccaaatagcttggattacaggtgcgtgccaccacacctagctaagttttgtattattagtagagatggggtttcgccatgttggccaggctggtctcaaactcctgacctcaagtgatccccccacctcggcctcccaaagtgctgggatcacaggtgtgagtcaccacacctggccaggatcacattattaaaccaaattaaagtttatgtgattggttgcaatatttgtctaattttatatgttttcttcaggaaaactttagaactcaaaaatcatttacagctgattaaatagcaagtaaaatgtacttgtggtcattgccgtataacattaggcacacgcttctaacacttctataatatctagattttatttacctcattttaacttgcaatgtctgtctatctcatgaactctccataaatccaagaactgcctgtagttttcaaaatgacatgtgggtttttactgttatcattgttatttcgatagggctttttcctgattttgggtatacaagttccaaacttgcataataattgctaacgcactaggcgatatctagggccagtctgttaaaggggacctctaatgtagctataagacaggttggtaaagatgaactaacataagtttaagctaataattcagtagttgatgcagtatttcacagtagagcccgagcttactcatttttttcaaaatttggatcctgatactcctttttcagagttcagaactgaactgctcccctaagacctcagaatcttttgcattgagacatatgatctatttataaataaaggttatcaaatatcttgttgaactaattaggttgatcaaattaggatcccaaatattggggtccctgacatctgagcctttatctaaaaatgtttctgtaacataatgacagcctttatgtttgttaattgcctatagtaaagaagcaattttaagcctattctcatttccctctcccctacaaaaaatgataaaagctttccaattacttacatatgctctaacaagtgtctcaggattcattaacagaattttatagagtacagtaattcaaatatagcacagtacagagtttaccaaaaacacataaaactttgctagatagacagtgaggtggaaaggaactaaaatgtatctctcttgaatagcatttggggttcaattgaatttgttgtgtttacaacagcaaagcaccgttagcctggacagttgcttatggcatcgatagggttggataatattctgggatttgttgcagcagaattcctctatctgatgatcagcagttgaacataaacttcataattatagtaaaatttaggaaaaactatgagtgtgaagagtatgaactgattgggtagattaggcagagtgcattatgggcaagacaaaggttttcgatattaacttcttttaaaataaactttttattttcaaacagtttcagttttacagaaaaaatgtgaagctagtacagagaggtctcatttaccccacacccagtttctcctgttattagcatctcacattaatatgtggtatatttgttacaattaataaaacacattgatatgttaatattattaaaaaaaaaaaaaaa

SEQ ID NO: 505 - DNA, 4159 bp, Homo sapiens
acttacaggggaggaggaggcgctgaggcagagagaaaattgtactgtgaggaccttgacagcttcacaggcgggctttttcttttgcctccctatatgcgctagaatatctatttttctcttttacaaactgactatataaaaccacctcttctggcattgcagaaagcaattgactttctcagagccacccggcaggctatcggggcatcctcgaaaaggccagggacaggggcgcaggtgcaccaagagatctggcgaggggtacgcttcctcgagacttggggctctttctctctgcgctctccagacactgaactctgagctgcaaggacaagaacgccaccaccttccctactaaggctctgccacaagcgcatcccagtgaggtgtatccagctgcagccgcctccggagcttcggagcgctcagacctccctccctcgcgcatctccagcctaagggttgtcccacctcgccataacacggggctctcgcgcgggcatcgaggattctcagcttttggcgtcccagtcctgcctctgctcctgcctggtggtgtccccacgcccaggtcctgcggacccgaccacggctgaaacgcgcggctttgccgtctgcgctccagccttcgcctggcagagcgcgcagcccacctagcgtcttctggctctaggggtgcagagggcgcatcccgcctcttcctccgcccccgggccccgctgtcctcccccacctgctgaccagcctactcctgcgtgagctgccagccttttgccttctgtgcgtaaagcatgtcaggctctgggcgaaaagacttcgatgtgaagcacattctgcgactccgctggaaactcttcagccacccgtctccttccaccggcggcccggcggggggaggctgcctgcaacaggacggcagtggcagctttgagcactggggacccagccagagtcgcctgctcaaaagccaagagagaagcggtgtgagcactttctggaagaagccttcctcctcttcctcttcatcgtcctccccgtcctcttcctcctcttccttcaatccgctgaatggcaccctgcttccagttgccacgaggctgcagcaaggggctcctgggcagggcactcagcagccagccaggactctcttctacgtggagtcactagaggaggaggtggtgccaggcatggactttcctggaccacacgaaaaagggctggttctgcaagagctcaaagtggagccagacaactctagccaggcaacaggtgaaggatgtggacacaggctgtcatcaaccggccattcaatgacacctcaaagtgatttggactccagtagctctgaagaattctatcaagctgttcatcatgctgagcaaaccttcagaaagatggaaagttatttgaagcagcagcaactttgtgatgttatcctgattgttgggaaccgaaagatacctgcacataggcttgttctgagttcagtctccgactattttgcggccatgtttacaagtgatgtttgtgaagccaagcaagaggagatcaaaatggaaggcatagaccccaatgctctctgggaccttgtccaatttgcatatacaggctgcttggaattaaaagaggacaccattgagaaccttcttgctgcagcgtgccttcttcagcttccacaggtggtggaagtgtgctgccacttcctcatgaagcttttgcatccatctaactgtttaggaattcgagccttcgcagatgctcaaggatgcattgagttaatgaaggtggcccacagctacacaatggaaaacataatggaagttatcagaaatcaagagtttttactccttccagctgaggagctccataaactactggccagtgatgatgtcaatgttcctgatgaagaaaccatcttccatgcattgatgatgtgggtcaagtatgacatgcagagtagatgcaatgacctgagcatgcttcttgcctttataagactgccactgcttccaccacagatattggctgacctagaaaatcatgcattatttaagaatgatctggaatgtcaaaagctgattctagaagcaatgaaataccatctattgccagaaagaagaactttaatgcaaagtccgagaactaaacccagaaaatctacagtcggaactttgtatgctgtaggaggaatggataacaacaaaggagctacaactatagagaaatatgatctgagaacaaatctgtggatccaggcagggatgatgaatggcagaaggctgcagtttggtgtggctgttattgatgacaaactctttgtaattggaggtcgagatggcttaaagacattgaacactgttgaatgttacaatcccaaaaccaagacatggactgtcttaccaccaatgtcaacacacagacatggtctaggtgtaacagtacttgaaggccctatttatgctgtgggaggccatgatggctggagctatctgaatacagtggaaaggtgggatccacagagtcaacaatggacatttgtagccagtatgtcaattgctcggagcacagttggtgtagcagcattgaatggcaagttgtattcagttggaggtcgtgatggaagttcctgtttgagttcaatggaatattatgatcctcatacaaataagtggaacatgtgtgctcccatgtgtaagaggagagggggtgtcggagtggccacatgtgacggttttctttatgcagtaggaggtcatgatgctcctgcttcaaatcactgttcccggctactggattatgtagaaagatatgatcccaaaacagacacttggaccatggtggctcctttgagtatgcccagagatgctgttggggtctgtctccttggtgacagattatatgctgttggtggctatgatggacagacatacctcaacactatggaatcctatgacccacaaactaatgagtggacacagatggcttccttgaatattgggagagcaggtgcctgtgtggtagtcatcaagcaaccttgacttattgatattttacttggaaagattttacttgctggagtggttatttttatattgaatggcaagaatgagaacttccagagatgaaaactcttcaagaacaaggatctctgtagcgttacctactgatgttgaaagagttagtagatcaaacagaatagtaggaaacaagaaaacattaaacttatacaggaaaaatgtctggccatatgttagttagttcgggaatggttattggtaatttgttttgtattatagcatacaataactagagttaccaaaggcttgttttttcttgagcagttgaaaggagagaccaatatttgtgacatggatagtttcatgaccacaactcattcaatcattttatagtctatggcaatatccaagagattgccaagagtagaagacagaatatttcatctgacagtatctgattggtttactgtttttctaatcatatgtggtcataacgggaagcagaattatgctttattcaaacaaacctgcttctgcctcattttcctaagctatgagaacaattagagaaacagattcatgcttgtatcttgcattcagaaaacaaactgtcctactaatcaaagctgcatatctcatcagagataatggttgaattttattgcaaccatattggcaatctgaaactggcaaacacaaaggattgttttcactaggcttaccattttgctttgcttttttaacacactgagccaaagatgcagtgtaattattgggcttttgccttatgttgagttcagtgtaagcatggaagctagtgattctgaatgatatatatatccattgcatgttgaactcctttagaattttgttcttaaacaaacttagaatttcaaaagaaaaacatatgatccattaagttggagtgtttatgattattgctagaaagaaggcagacttcatattctcatcgcccatttttcaaacttgttacattgatctgtacattattttaagccacatgtttgtaattgtttaaaacaaagtggaaacattacacaatgtccttaataaataggcccatgtaaattttaattacaattaataaatgatcaaaaaatttgcatttaaaaaaaaaa

SEQ ID NO: 506 - DNA, 6806 bp, Homo sapiens
gattctttgcagcctagacagaggaggcaggagccccaggggcgggctaatcgcctgggctggggatgcctgggcagatgcagaggaagctggaaaggtggcagtgcacctgggtcgctggagctgccgccgttcctaggagaccaaggagcagcaagcctgcgggggagggggagcaagtgggttgctgcttttagcagctgaaagggctgcagggagctctgggtaagacattttctgttgctgctgcttttgcggtagaagctgctgcgagtaagtcagaggaaggaggattgagaagggaggaggcttcacttgcagccatgctgaatcactgttgctgatcagatttcccactggtctgctgggagaatcaagaacagaactaggatccccgagtgcatacacagttcagcagctaccaccctggctgggcctcacacaatggagggtgaaagtgtcaagctgagctcccagactctgatacaggctggggatgatgagaagaaccagaggacgatcactgtcaaccctgcccacatggggaaagcattcaaggttatgaatgaactgcggagtaaacagctgttgtgtgacgtgatgattgtggcagaagatgtcgagatagaagcccaccgtgtggtcctggcagcctgcagcccctacttctgtgcgatgttcacaggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcatttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaacccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggtcatgattgtggttggcggccaggcacccaaggcaatccgcagtgtggagtgctatgatttcgaggaggaccggtgggatcagattgctgagcttccttccagaagatgcagagcaggtgtggtgttcatggctggccacgtgtatgccgtgggagggtttaatggctcactgcgggtgcggacagtggatgtgtatgacggcgtgaaggaccagtggacgtccattgccagcatgcaggagcgccggagcacactgggcgcagcggtgctcaatgacttgctctacgcagtgggaggctttgatggcagtactggcctagcatcggtggaagcctacagctacaagaccaacgagtggttctttgtggccccgatgaacacgcggcggagcagtgtgggtgtgggcgttgtggaggggaagctatatgctgttgggggttatgatggagcttcccgccagtgtctgagcactgtggagcagtacaacccagcgaccaatgaatggatatacgtggcggacatgagcacccgccgcagtggcgcaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcagtgtggacaccattacccacccccgttcccctgaggtgctctggcctatgccctgagcaaggggggtcttgacatccccaggcagcacctttgggctttgttttggtgtttctacagggacaatacagaccctggagtgtgtgtgtgtgtgtgtgtgtgtgtagaccatggtgtttctctatgtttctctaagttggggggtgagcgtgtgtgacagtctactggatttctttactactgatcctttcgctgtgttaaaaatcaagtcacagagacctctcttctggatttgtcccatggggaccctgagactactaaagctgctttcttctgaaggtccagttggacagtctgggaatgtccagaaataaccagtgagaggggcagttctctggccacacccacttatgtactttaactactgtgactttgtctgcagaagagctggaaaattctcgaagctgcaccgtgtcctctgtgtgctagaataagggacaaatgggttccctgtgcttctcagctcactgtttttccttgagttctcctacaggaagcagatgagaactgcccagtcttcaggtttaggccattggtctttgatgtcatagattccaggcctgggaggtgttatgtctcttcagctgggaaaactagctcttcagagaagcctcgggtaacactgaaaaacaaaacaaaacaaaacaaaaacaggaaaaaaacaaaaaaccaaagtggtaaggattcagttcctgcctataatggtctcagagagggtcctacttttaggttttcccaggacaggacagtccccatttatacttattatcccagtttaattattcacagcaccccattttactcagaagtgttctggtctggaggataaataagaggtcaccctcctccagacccaaagatagatttgtgcctgtgttggatggggtcgtgtgtgattcagatggacattggatggcttcaaaggaatataccactagagctggcccttggcactttgtgacagtggtcaagtctgtctaatgtccttgtcttctttttcttgtgctttccccctattccagggtgtgcaccctctccccaacccccaagaaccccactactgctttccctgtgaggtaggagatatcagtgggccttggatttgaggcttcctaagatgtgcttgcattttaaaaagggagcttggtgagagctttgctaattcacaggtaaaaattattaacaatagaacttcaagcatcttgaggagcgggcatttgagggggcatggagtaatttgtatttaaaaaaccttaaagttgtgctgttcctaaactagcaaattgctcatgctgaaatttctggcataagcaggggaagtcttgtgtctggagaatagtctcataccttgcagtctgggacaccctccctactttgagaatccacctacaggaagccaaggaactttataaatcctgatgttggacttctgatacgactgggctacttccaagcaggtgctgcaggagattggcatcccccagcccctgcagttagaaaccccgaagtcttcccagccagtgagccactttgtgtatttactgtatatttattgtgccctaaatgtgcaactctcctaaagacaaaacttctctttctgatgttaagcacatgttacttcaacaagatgcttggagaacaacaaggtacccagaatttttagaagccttcagaagaggctaaaatatccagctttgggggacctggaagaaatgtctccaaaggaagcaaggcatgttttagttgagtgctctggtctcactatgaagtggggatgactgtggcttcataactctacctggctgtgggttggaagctgatggaatgagaaatgtcctttctccttctctgaggaaattttgagacttgtttcggtgtgtctgtgtgatggggatgaggctggggttgggatctgatgtatgccattcacagaagctctcaatttcagatgataggtgaattccctgcccctcccccaccactgagaagctagactttcatgcgggagaggctacttttatgtgtcgtcttccggggaagggtccctccactgaaagctagccagtcatgttttctgtttttggatttttgcaattggtttcacctcatgtctccctccctacaaagcactgcctctactgggcgtgctgccaaggccatgtgcactccatcctcatgtatcctttttcacggggaccagaacactggtacgtcatcaccaaagccaatctgctctagctgcccacagatgccaccaaaacctgctatctcttcatcaccaggtacgattctctttccacagtggacacagcaggctattttctagtttgtgctggtcacgtggtagatgaagcctcttactgccccacttagggtggccacggctgcttgtgaatgcagctttgccagtggcatatctgtcatctgattgcggtggtgaaatggaattgaggcccaaggttagaagcagccgagacgccacttggatactgatttgaacaatgtagaagtcagattctgaattccaaagttatttctcataagtacccaatggcatctctccatctacaaagttgcagtattatgcaaataaaactgacctcattttctgctatgcaataagaatacttaattctagttcccgacaagccagttgcaatatcccctaagatgctttttgagctgtcttactttgatatctgttgtgtaatgtttgtatatttctgagccagatcctttcaaagattgcctttttataaaattgaagctatagcttttaggctaaaattttaacgtagatatttttataagatatttttttcaagagtttgaatcgctttttattgtccatgataatgaaatgttgtgttctttgcatcattcactctcaaacgtagttcatgcctgtagctctcttccttttgtttctcacccttcagaaacatatttttcagtagctccaggtagatgagccttttttttttttttaaaaataccatattcaagggagtctgctgaattttaaaacgcagtcactggtgtttcttgaattgctagggactgatgttatgttcgactcagcacttgcccgtctgtattgattgtgtctttttttttttttttggagtctgctttctgtgggggtgaggccgggctgtctcgtggtggctcccactgacgggcactgagcctggtaccctgtggcatggagaagcctcagggaaaggcctgcccccccagcacatactcccatagtgtcctaggtccagccgaccattccttattctcttctatctccttgttgatctgaagcttccaatagcttgaggcctttgctgctggatgatgccctttttgggagcatcttgtctctaacctttaaaagaggggtcaatcctcatgatccctgtgtgttaagcatatgctttgcaggtgctcacactacacttacaacttgcttcttgagctatgtctctactccaggctctgttttgtgtatttatctgccatttgcatcatggtttttaaaatttattattattattattattgttgggacaggtgccatttaaattgcctccatgctccccatttgcacctagctggatcaagttgggaggctgagcaaactcatattccagttagttggagtttttaaaggctctgtttgcctggagaagcaaggaggttagaatgtaatttttttaagcgtttgcactatttagagtcctaagcccctcatgttcagctgtgctgtgtttctactgaccaagcaggagagccagcagcacttccagcatttgggaatggaagagatttcttctgtagtggataattacagcctcatagcccctgtgcagccttcgtcatgggactcagtgactcatggatatagcatcagccatggcaggaatgcacaggactgtggcatttgcagcatcaaatcaccctagtgccatgtttggttatgagattgtaaattattcgctcccccatcctcccctcccctcattttcagtggcaatagaggacccttgttgtacttcttgtttaatttgcatattatgtgtaaaatgctttcgttgaaagaaaactgaagacactgaatgtgtatgtctgtgtgggtgctctgtccctgtggttgtcatagccagtcagacttgatcactgacaccccgtacaacatattgcataggtaagatcctcgatctggtgttctctgcgtggctgttagggactgtatatcttgtaaaagaacacttgtcacatgcttgatcagttacagcaatagctgaagaaacatttcctcaaatgtattattttaacaggaatcatgttctaatttcccatcctttaattttaataaaagctgaactgtgtgaa

SEQ ID NO: 507 - DNA, 5880 bp, Homo sapiens
gctagaaggctacaagtattcacagtgtatcataggcagtgggggaggggagagaaagcaagaaagactgctctcggcacttgtgcttttgttagttctacagaagaggcagaaaaacaagagataacaaaggctccgtttcctttctgtgagagaaggcttttgtctttcctcctgctacgatgtcagtgtctggcaagaaagagtttgatgtgaaacagatcctaaggctacgctggaggtggtttagtcatccttttcaaggttccaccaacactggaagctgtcttcagcaggaaggatatgagcatagagggaccccggttcagggcaggttgaagagccactctcgggacagaaacggactgaagaaaagcaacagtcctgtccaccacaatatactggcaccagtgccaggaccggcccctgcccatcagagagccgttcagaatttgcagcaacataatctgatagtacattttcaagcaaatgaagatactcctaaatcagttccagagaagaatttattcaaagaagcttgtgagaaacgcgcacaagatttggagatgatggctgatgacaatatagaagattctacagcaagattagatacacaacactctgaagacatgaatgccaccagatctgaagagcagttccatgttataaaccacgcagagcaaactcttcgtaaaatggagaactacttgaaagagaaacaactatgtgatgtgctactgattgcaggacacctccgcatcccagcccataggttggttctcagcgcagtgtctgattattttgctgcaatgtttactaatgatgtgcttgaagccaaacaagaagaggtcaggatggaaggagtagatccaaatgcactaaattccttggtgcagtatgcttacacaggagtcctgcaattgaaagaagataccattgaaagtttgctggctgcagcttgtcttctgcagctgactcaggtcattgatgtttgctccaattttctcataaagcagctccatccttcaaactgcttagggattcgatcatttggagatgcccaaggctgtacagaacttctgaacgtggcacacaaatacactatggaacacttcattgaggtaataaaaaaccaagaattcctcctgcttccagctaatgaaatttcaaaacttctgtgcagtgatgacattaatgtgcctgatgaagagaccatttttcatgctctaatgcagtgggtggggcatgatgtgcagaataggcaaggagaactggggatgctgctttcttacatcagactgccattactcccaccacagttactggcagatcttgaaaccagttccatgtttactggtgatcttgagtgtcagaagctcctgatggaagctatgaagtatcatcttttgcctgagagaagatccatgatgcaaagccctcggacaaagcctagaaaatcaactgtgggggcactttatgctgtaggaggcatggatgctatgaaaggtactactactattgaaaaatatgacctcaggaccaacagttggctacatattggcaccatgaatggccgtaggcttcaatttggagtcgcagttattgataataagctctatgtcgtgggaggaagagacggtttaaaaactttgaatacagtggaatgttttaatccagttggcaaaatctggactgtgatgcctcccatgtcaacacatcggcacggcttaggtgtagccactcttgaaggaccaatgtatgctgtaggtggtcatgatggatggagctatctaaatactgtagaaagatgggaccctgagggacgacagtggaattacgtagccagtatgtcaactcctagaagcacagttggtgttgttgcattaaacaacaaattatatgctattggtggacgtgatggaagttcctgcctcaaatcaatggaatactttgacccacacactaacaagtggagtttgtgtgctccaatgtccaaaagacgtggaggtgtgggagttgccacatacaatggattcttatatgttgtaggggggcatgatgcccctgcttccaaccattgctccaggctttctgactgtgtggaacggtatgatccaaaaggtgattcatggtcaactgtggcacctctgagtgttcctcgagatgctgttgctgtgtgccctcttggagacaaactctacgtggttggaggatatgacggacatacttatttgaacacagttgagtcatatgatgcacagagaaatgaatggaaagaggaagttcctgttaacattggaagagctggtgcatgtgttgtagtggtgaagctaccctaaagctatctatctttatcaaatggaatgaaactagataatttcaagaaactgagtaggacaaagggagaaagaaatacatgttctttttcctgcaattaataatcagactggaaaattgttgtatcattttaatttgtagttacaattgctttcattcgtgaagccgaaacgtttttaaacatgaattacatatgaattattaagcatatgtgctttcgcagctgataatataaaaggaaatcccacagtctagatatagccccattactacaaaatgctaaaatatttaatgaaaattgatggtggccacagtgtgcaggttataaaagcattaatacatttcaaggtaagagccttaaaagttaaaaacattttcagtttttttttaaaaaacgtactcttattatctggaacatagaaatataaaaggtaacatctaaagcttagaatagtgtgatttttagtaagccattattctcctattcaaataatatcccaaagagctaaacaattccttacatttaccaagaggaaagcttttactgtgttgaagctaaaaaaataatggctctttgacaaaacttgttatgttgatcgcggtatgtcaaaatttttacaggtttgctcatctgccagagcacacatataaatttggtatttcttaacatattatcttgttagatttgttaccagtaaaatattactgtaatttcatatacacagtctatacaatgaaataatgaatatttatcatattgatacaaactgtgacctcagcttcagagtgtcagggcctcacttgtatagaatgtaatgttctcctcaaacatttatgttaactctataaacaaatatcgttaagttaaacaagttttcaaaaacaaaacaatttttaaagtaccttaaaattgaggatgttactcagtgttaacacatgggaacaccaaaatattcaataagcctggtcaattctatagttatcttttttgtaccaacacatgcttttctgttactgttatattatccagtagaaaatgttaggatatgtgtgctatataaaaaaaaaaaaagacttgttaagttttaaaataacaaaaatggctagttgaatagtattttatgtgtaattcttccatttattctgtttaattatacaactaagatgaaatattgaaaaaccctttgtgaaagtaacttttcaagtaaatgcacaactttagaatttctacaaataagttcttttaaacagtctttttattgtggattgtgaaatcaaaatctggagaaatgcttataaaatatactactagcttttaagttttaagaaagaagaacgtaagttgtacaaagatatttgtactttgacaaactgaatttaaataaactttatttcctctcactatagtgtggctttagaatatatcaagtacaacctgaatggactttttgattttacatttcctatatcactaaaatacttaaacacaaaaataaaattccactcctttatttcttcttacacctgccattgtctctaattctaaagagagagctatagatttctgcagttctagaggtgaagatagagacatagagaggctgtgaaacacacatacagccctgttaggtcttttgaattcacaccttattgaaatcagtgtagaagtagagttacctaaacctttatcgccaatgcacagcttggcctgttaagttaaatgtgggtgtcaaccagtggaaaagatcaaaggaccttttgcagcctagcttgccaatcttccagtaacaacgaggtgctaccaataggcagactgtgtctagagtcatgcatggacaagaggaaagtgaaagttgaatactctcttctcaatggcatagctggacttgattaagtattgactcatagaagagacatgtatgtttcccggggctaccccttcatagctgcatttaaaaatggtgttcaggccactatggctgctgtggtttgaatatttttttccctcgaaaactcatgttgaaacttaactcctaatgtagcagtactgagaggcagggcccttaagaggtgattgggccatgaggtctgtgccctcctgaatggattaatccattcatggattaatggattattatgagtgggggactggtgactttatatgaaaaggaaggaagagtgacctaagctagcatgctcagggtgcaccgtatgtcccctggtcatgtgatgctatgtgttaccttgggacttacctgacagctcttaccaacaagaaggccatcccagatatggcctctcaacctcagacttctcagcctgcctaactgtaagaaattaattctttttctttataaattacccaggttctgttttaagcctcagaaaatgaactaagacaatgccctagatgagctgccaaaatctgagcagatatgagccatcagaatagagacctgcagaggcccagggcactcaaacataactgtgcttgtctcagtcaaacttaattgggaaaaggaggagtaagagcaggccctttctgacatgctttagcagagataacttatcagggctagtttaaacaaatgtgtataggaaaggatgttatttatatattcttacaagagtgtaagggctcacacatttactgtactcagatctgaaagacaatgttgcttcttgatttttttctataatcactatgaccgtgttcacgattccctactctgcaactctcagcatgcatcatgatgattctctaacactgtctgtcaccttcctgtatttccacagagcatgcaagaacttctacaaaacttctataccacacagaagctgaaagagactctggggcactaaattcagatcctttctccacacagcaatgacatttatcaatctgactcaggtgtggctgttgcccctttttgatatggagggaacactgaaagacagtttccttctggagttccaaatgcaatatagaaaaaaaaaccctgtgactctggattttattttaagttctctaacaagactcctaccttgagatcttagtctaggtaaagaaaaaaaaaaaaaggtcatgaaacacaaatgtcctcaactgtcatcattctatgtttactttctcccaatcacatcacctgaggtagaagagatttttcagttgctatttctcttcgtaatgaattttctttacatcctgtccacactgctggagatactaagtcccaacctaaatgatggaaggagcatctcccctcttgtctgtggaagatatcacatgaactacctaattttcaagcatggatctccatatttcaaaggaaagttttaaaaatgtttttaaaacttcaaatatctcaccacagtgaattatgggtaaggtgataatatgtttaattagcttgatttaatcatcccacactgtatacatatgccaaaatatcattttgtatgccataatatatatgatttatgaattatagtaatattaataaaagtgttaaagctttaaaaaaaaaaaaaaaaaaaaaaaaa

SEQ ID NO: 508 - DNA, 7728 bp, Homo sapiens
actgcaacggggatagtgttttctgtctctgtcatttgtggtttaagaaaaagggggtggtgttctgcatttgaaaggactttaatgaatgctgtcagtgtttgtgagacctaatggtcagtatgggaaaggagagccgggaaagtggtctagctgcttcaggataggtggatgagagtttgctctgattgaacggaatgttccaccgtgtttcatctttattcattatcctttgttctttaaaatctgatatattggcataaaagtaattgtagatatatatatgaatgtgatttattttcctttacatatttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtcattgagatgtctaagatgctttttattttaaccccagttaataaccaccttacggaaaataatatttgctaatattgtttattgtgaactaggaatcaaagtttttgtatgcatcaatgcacttaatccttataacaaccttatgaggtagttctattccctttttatagctaaggaaattggggtacagagaagttagccccaaggttatatattgcaagtaagtggcagagcagggattcatacaaagaccttctcactcagcagtcttcactcttactattcctgccactaggtagaaaaagaaagatttcggccgggcacagtggctcacgcctataattcccagcactttgggaggctgaggtgggcggatcacgaggtcaggagatggagaccatcctggctaacacagtgaaaccccgtctctactaaaaataaaaaataaaaaaaaattagccaggcgtggtggcgggtgcctgtacgcccagctactcgggaggctgaggcgggagaatggcgtgaacccaggaggaggagcttgcagtgtgccaagatcgcaccactgcactccagcctgggtgacagagcgagactccatcaaaaaaaaataaataaaaaaaaaataaaagatttcattttatgtgaggaattattttaataaaaaaaagagggtttatgctctatagtaataaaatttaccagtaacacccaatcagaaaattttggttccttagtatttagggaagacttttgtttaaatctcttatggaattttacatgttttgatttagaaaagtagatgcaatataatatatttcaagttttatacatattagatgaattgcatggtattttaggcaacttaactataaacaaatttattcatagaagcattgttgccaacaatttagatgacctcgatgaaaaaacacaccaattgacaaaactggctcaaaaggaaataaaaaatccaaacagacctgtaacaagtaaagagattgaaccagtaatcaaaaatctcccaacaaagaaagtccaggactaaatgagtttactggcaaactatgccaaacatataaagaagaattaacactaatccttctcgaactctcccaaaaaatggaagagaaaggagcaccctgtgacattctataaggcggacattaccttaacaccaaagccagacaaagacctcacagggaagctacagaccaatatcccttatgaatatagatgcaaaaaaacttcaaaatactagcaggccaaatccagcagcttattaaaatgatcacacagcatgaccaagtgagatttatcaaagaaatgcagggatggttctacatacaaatgtcaatcgatgtaataatataccatattaatagaatgaaggggaaaaaacagcatgatcacctcaattgataagaaaaagcatttgacaaaaatccaacaccctttcatggtaaaaacactctgcaaactaggaagaaaagggaactttcttaacctgataaagacatccataaaaacccacagctaacaacataatagcaaaacattgaaaatttttcccctaatatcatgaaaattcctgatttccccactgctattcaacattatactagaaggtctagccagagcaattaggcaagaaaaagaaataaaatgaatcccaaataggaagaagtaaaactacatttgcagaaaacatggtcctatatattaaaaatcctaaagaatccacaaaatgattccggctgattttaaaaattcagcaatgttgcaggttgcaagatcaacacacaaaagtctaagaaaaacctgaggggaaattaaaacaatttcatttacaataacatgaaaaagaataaaatacttagaaataaatttgaccaagaaagtgcaagacttggacactgaaaagtacaaaacgttgctgaaagaaattaaagaagacctaaataaatggaagacatcctgtgctggcaggttggaagacttaacattgttaagatggcattactcccaaaattagtctatagatttaatacaatccccattaaaattccagtgacccttttacagaaactgaaaagctgaccctagaatttatatgggattgcaagttactgaaggtactcaagtctgttcaaaacaatcttgaacaagaataaagttgaaggactcacattttccaatttcaaaatttactgcaaagctacttcaatcaaaacagtgttgtgctggtataaaaatatataaagcaatagagtagaatggaaagtccagaaacaaattacgccaatacactatggtcaattgatttttgacaagggttccaggaccattcaatgaagaaagaacagtgtcttcaactaatagtgctaagacaagtgaatattcacatgcaaaagaatgaatttgtacctgtacttcataccatatataaaaattaattcaaaatagatcaaagacctaaatgtaagagctaaaaccataaaactttgagaagaaaatacaggaataaatcttcatgaccttggatttggcaatggtttcttagatatggcaccaaaagcacaagcaacaacagcaaaaaaaaaaaaaaaaaaaaaaaatcaaaattaaaagcttctacatatcaagggacactatgaagaaagtgaaaagacaacccacagaatgggagaaaatatttgtaaatcttacatatctggtaaggaactaatacctagaatatataaggaactccgatgctcgacaacaaaaagacaaaccaattttaaaatgggcaaaggacttaaatagacatttctctaatgaagatatacaaatggccgacaagcacatggaaagcactcaacctcatcagtcattatgcaaatcagcgccacaagaagataccacttcacacctattagaatgacgaaatagacctaggatctaaacctacaggaaaaaaaatgaataatagagaaaataaatgttagagaggatgtggagaaattgaaaaccttcattcgttgttggtgggaatgttaaatggtgtagccactgtggaaaacagtttggcagttcctcaataagttaaaaaaaagaattaccatatgacccagcaagtccactcctgggcatatactgaaaagaactgaaaacaggtgttcaagcaaaaactttcacgcaaatattcattgcagcactagtcacagtagccaaaaaagaggaaacaacccaaatggccatcagctgatgaatgaataaacaaattgtggtatctccacacggcacaatagaatattcagccataaagagaaatgagggactgatacatgctaaagcatggatgagccttgagcgcatttttgccaagtgaaagaaggcagacacaaaaggcaacgtattgcatgagtgcatttatatgaaatatccaaaataggcaaatccatggagacagaaagcagataaatggttgtaagaagctgagagaaaggagtggggagagattgctaaaaaggagtttccttctagggtgatgaaaatgttctggaactacttattggggatgattgcacaacatggtgaaggtactcaatgtcactaatggtaaatttcacatacactttaccataatttttaaaaagctttattagctacattatgttatgatacttaaatgtcataacaatagcattctgtacgcttcactaggataaaaacttcggatttatatgcatctggaagagaaatttttcactgtaatttgcaaataaatgaatttctaaaaatctaacagaaaggctcttaaatcttaatttcaacctaagaagggagtgagaaacaacgagaaccatgaggggagagttaacggggaacttccccaccgtccggtacatggcaggcattccacaaatgttttctgaaagttgaaatagacatcttttcatgaactctgtaatatttgaaattattgataactcttacacaaaaacaaatattcaataaaatgatatttaatttcactgtgaaaaaaaaaaa

SEQ ID NO: 509 - DNA, 6320 bp, Homo sapiens
aatccgctcagctcctgcaatggggcctgcctgacacttgggcgctccttcagtctcgatgttgatggcaggacaaaggggcgcctggaccatgggtgatgtggtcgagaagagtttggaagggcccctggcaccttctacagatgagccctcccagaaaacaggagacttggtcgagatcttaaatggggaaaaggtcaaatttgacgacgcgggactctccttaattcttcagaatggcctggaaaccctgcgaatggaaaacgctctgacagatgtcatcttgtgtgtggacattcaggaattctcctgccaccgcgtggtgcttgccgcagccagcaactatttcagggccatgttctgcaacgatttaaaggaaaagtatgagaaaaggatcattattaaaggggttgatgctgagaccatgcacactctgttggactacacgtacaccagcaaggcgctgatcaccaagcagaatgtccagcgggtcctggaggctgctaacctcttccagttcctgcggatggtggatgcctgtgccagcttcctcactgaagccttgaacccagaaaactgcgttggaatactgaggctggctgacacacactcgctggacagtctaaagaagcaggttcagagttacatcattcaaaactttgtgcagattctgaactctgaggagtttcttgacctgcccgtggacactctgcaccacatcttgaagagtgatgacctttacgtgaccgaggaggctcaggtgtttgagaccgtgatgagctgggtccggcacaagccatcagaacgactctgcttactcccctatgtcctcgagaacgtgcgcttaccgcttctggacccgtggtactttgtggagacggtggaagcagatcctctcatcaggcagtgcccagaggtcttcccgctgctccaggaagccaggatgtaccacctttctggcaatgagatcatttcggaacgcaccaagcccaggatgcatgagttccagtctgaggtgttcatgatcattggcggctgcacgaaggatgaacggtttgtggcagaggtgacctgcctggaccccctgaggcgcagccgcctggaggtggccaagctcccgctaacagagcatgagctggagagtgagaataagaagtgggtggagtttgcatgcgtgacattgaaaaatgaggtctacatctcaggtggcaaagaaacacagcatgatgtttggaaatataattcttcgatcaacaagtggattcagattgagtatttaaacataggccgctggaggcataagatggtggtgttgggtggcaaggtctatgtgatcggaggctttgacggcttacagagaatcaacaatgtggagacctacgacccctttcacaactgctggtcagaggccgcacccctccttgtccatgtcagttcctttgcagccaccagccataagaagaagctgtatgtgatcgggggagggcccaatgggaaactggccacagacaagactcagtgttatgacccttccaccaacaagtggagtttgaaggcggccatgcccgtggaggctaaatgcatcaatgcagtgagtttccgggaccgcatctatgtcgttggtggggccatgagagcgctgtacgcctacagcccgctggaagacagctggtgcctggtgacccagctcagccacgagcgggccagctgcggtatcgcgccctgcaacaaccggctctacatcaccggcgggcgggacgagaagaacgaggttatcgccacggtgctgtgctgggaccccgaggcccagaaactgacagaggagtgcgtcctgccccggggcgtgtcgcaccacggcagcgtcaccatcaggaagtcgtacacccacatccgcaggatcgtgcccggagcagtgtctgtctgacggcaggatggggagctggagagcccccccgaccctcagcgtacccgcctcacctctcaccctcctccagtcccacttcaggcagcaggctcgagtttgaggccatacatcaggggatccccttgactcactttgggggaaccttggaagtcacagtttggggtcacttgagaccggccaggaatgtttgcatgacctacctcaggaggggaggcgaggaagagtaatatttagcattcaggacccacccaccctatgccggcttctgtgccaggcacttccttttatcggttcatttaacctggtgactggctcttatcacttctagtttacaggtgagggaaccaagtttcacagaggctaagtggcgtgcccctgatcactcagatagcaagtagctaccccaggagtctaaaatccaggtctttcatctccgaagtcaatgctctttccaccatgctgcctatctcagagcaggaaaaacaaacaaaaaacaacaacaaaacctggctcttgctgggcgtggcggctcacgcctgtaatcccagccctatgggaggctgaggcgggcggatgacctgaggtcaggagttcaagaccagcctggccaacatggtgagaccgccccgtctctactaaaaatacaaaaattagccgcgtgcagtggcaggcgcctgtaattccagctactcaggaggctgaggcaggaggatcacttgaacttgggaggtggaggttgcagtgagccgagatcgccacactgcactgcagcccgggaaacaaaagtgaagctctgtcttcaaaacaaaaacaaaaacaaaaacaaaaacaaagaaacctggctcatttcttgtttcggcaagtctgctaaaagattcactcagcacagcagggaaataaaggtgtttcctgctttctttccttttctttcttattctgcatcctccctcgtccccgccctttaccaatatttaaaccaaggagtcatttgggctccttgccaagaacatctcataggttcttccacttgaaaggtctgggggatgggcttgggaaggcctgtttgctttgaaagagatgaaatacttgtgttctgtcctcctcccattgaaaccctcttttttttttttttgagatgaagtcgcccaggctggagtgcagtggcatgatctcggctcactgcaacctctgtcaccctggttcaagtgattttcctgcctcagcctcctgagtagctgggattacaggcacctgccaccgcgcctggctaatttttgtagttttagtagagacggggtttcaccatcttggccaggctggtcttgaacgcctgaccttgtgatctgcccgcctcggcctcccgaagtgctgggattacaggtgtgagccactgggcccggtctttttttttttaaatgatcataagatggcccattttggaccggaactgtcattgccagacagaattgtacctttagcacattctggtgccctggcctcttagtgttcaccagttgtactgcaatatagacaagatgtctctagagactcaaactactgttttattaaaaaagtaaacacctgagcacagctggcctacacaggagcgacagattctccttgatggtacactttctagtttttacacagtgatttaggtccacgttcctgataccccatcctcctgaagccttcgttttcaagacttttaaaaagcacttctacttggttttttgatcagtgtagctcaattgtgacttaaagaacagaatctgtccttcactgtaagagctacagctttcaaatgagctcactggaaattcattctaatccccaagctggagaaacaggttaagagatcctgtttcatatgctgtatttaaaaagcaacaatgataacaacatagtaactgcgttacccaatggactttattttcatcatatgatttcaattctctttatagagttttatttcatatccggtgtggcttgttcttttcagcagtttgggaagttagttattagagttgatagtgaattgaattttcattaaacagtcacggttagaagaagctaatatttgaaacagattttaaaaacttgaaaaattacaggtgagatttctgtttatgccagattattgaagataaatataaatgtatgttggtgtgtgaaatgctctgtgccttagaagcgtgacagttcagctctctgctgtggaaagtaacacagggcaatagaaacatatttgtggaattttagaacaaactattgctgactcatgagcactataataaccatcaggaagctcccaactgaagcaatgtaacagtgtaatctagttcaattcagcaaacattcatggagttcttcatgtctgtcaagccttgaggacacccacgaatggcaaatctccacgctagacactcaatacaggtaaataggccaccagttaatattcttgtttttattttcttcaagttagctaaaaatgagatgcgtatgaagtgaggaggctggatccaagtcttgattgcctttcagggggtcaaggtggtaagctgtgcagtgaagtcaaccagtggccatggcttacatgtttgtctctttgagatcgccaccagaaccatttgtgaactgatttgtgaaggaaaagtcagtcttactccaaagactattgcagggaggaacttccagagaggaaatccaatgacaatggtactggcatacacagggagcctcccttcaaaaagacagcgcccctagtcagggaggggatggcggtcctttgataagacccataggcaaacttcgagcccatcagcaggtcaaccctatgctgggaaagtgaggatttgggatttctgtgctataaacctgattctaaatgtaggacccaagtttctggactacttcagaatacctaaatgaatcatggaaacactctttatgattttttacaacaccagatatgcaggtgaattgtggaaaatgtcatgtagctgacactcaagaaatagggattcctaataatggcatgggtagggaacagatacacctggttagaaggtctagggttctgtatatgaagctgccagtctgtagctcttcgagaaagaaagttcaagtcatttgggggaaacttaagaatagtcatcagggttttagcttctaggcaccagccaaggatgagaacttctaaaatctaaaatccatttcaagaaataaagacgaacacatttgcaggaaggtaactgttataacccacaccatcagcagggggaaagccaagctgagaataaacccagagacaaagaaccctcggactcaggcaggacatggcaggatgttctggcacagcagactggagactgaggcagggcctgtgagtggacagagcacccctggctgggaagaagaagatggggtaggaggaggtcaggttccaaggatgcaggtctggaaaatgatatcggaggccctggagtttgtgagcttggctctagtcccaagaagggtgagggagaataagggtaagggagtattctaggcaaggaactaaggaaggaatccccttcttagagcagaggcacaagttagagcaggcccagcatttgggccaacttactgtggggcctctgagctgctcagctgggtctcctgtcctagagggaaggtggcccagagtctttggtggagcggaatctgtagatgaggttaagggactccagttgccaaggttgatctgaaacaggcagggagctaagctcatcagaacaccaacagattcatgttctcgtcttagctttcatctattctggtctcaatggcttcgggaaacacacatatacacatacaccatgcccttgaactcaaagcaaactacgctctcagggaaatacaaatatcacgttcttatagctgtaaagtatagcttagctatttatagaagactatgaggtactgttgtgagttatttgcttatcctgttttattctgaaaaatgaaagtgctcaatagaatttttaacgttggcaacaccataaggatttcttatgttaagtcccaacttggggttgcaaaatcattttttcccttaatacctgggtgttgtattagatctcataatttgacaagttaaccttttagaaatccacatatatctcaaatctggctactgcaaaaccagttttgacaggtcagattttcatatgtataggtataaatagccaacactcagtgaacaaaatcctttaagcattttggttacataaagttgtatgttttaagtgatcaaactaagaatattgtttataggttttaaaaaccaaaccaataaaatttttatttattcaataaaatatgcacagaacagatgcaaatgtgttatatacaa

SEQ ID NO: 510 - DNA, 4576 bp, Homo sapiens
cgcgcggggttggtgaggttccgctgagggcggccggggctctgggagcgtggtaacgtggctgcaaccttagcgacatcaggaagaacagggtcgaggatcgagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggttggctcaaagctaatctcttgtcacaagctggtattggcttgtgttattccctactttagagccatgtttctttctgaaatggctgaagccaagcaaacgctgattgagattagagattttgatggtgatgcaatagaagacttggtaaagtttgtctattcttcacggctcactttgactgttgacaatgtccagcctctcttatatgcagcctgtattctgcaggttgaactggtggctagagcttgttgtgaatacatgaagttacattttcatccctccaattgcctggcagtaagagcctttgcagaaagtcacaatcgaatagacttaatggacatggcggatcagtatgcctgtgaccattttactgaagtagtggagtgtgaagactttgtaagtgtatcaccgcagcacctccataagcttttgtcctccagtgatctaaatattgaaaatgaaaagcaggtctataatgctgccatcaagtggcttcttgccaatcctcagcatcattccaaatggttggatgaaacacttgcacaggttcgcctgccattgttgccggttgattttcttatgggtgttgtggcaaaagaacagattgtcaagcaaaatctaaaatgtagagatttactggatgaagcaagaaattaccaccttcacttgagtagcagagcagtacctgactttgaatactccattcggactaccccaaggaagcatactgctggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtaaagtgtatgcagtaggtggacatgatggaaatgaacatttagggagtatggagatgtttgatcctctcactaataaatggatgatgaaggcatcaatgaacacaaagaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtaaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtggttttgatgataattctcctctgagttcagttgagcggtatgacccccgaagcaacaagtgggattatgtggcagcacttactactcccagaggtggagtgggaatcgcaacagtgatgggcaaaatctttgcagttggtggtcataatggcaatgcatacttaaatacagtagaagcgtttgatccagtgctgaataggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttacaaaaacctttttgtagactgtagtttattgattagttcaagcccatcacgaactaattaaacatattgttggtaaaaacagagattgaaattactgtttttatcatatttaaatccctctggtgtatttattgaaatttaattaaaaatatttctacatattgatttgaagccaggatattgatggacctacagatttaacagctcttcaaagttttaactagcattataaaatggcctattcattatatgtatatttttttataaatatttatcaagaacatgaaaatattttattttgtatttgcagtgcagtttggcacctctcttccaggccttcctaagtttttgttagttgtgtcttcgaatttattgtagttcaccgctggtcagtaatctggttcataaggaagctggggcagtgaaaaacacttcgttgatccatccagccctaaagttcattgactaatagctcatgcatcttattaaatgggattctggacttctacaatagtgtggaaagccacatcacaaaaaaagccacatcacaaaaaaaagccagtgcctattgagtatatcaaaccaaaaaagaaaaaaaaaagttttaagaggggtcaggctggcagataaaagtctcttatgaagcagatataaatccagtaagctatttttttctacctatgggcaagttcataagtcattgctggatctgaaccagtgttcttttgtgtaagtacaaccatatttcagtcagtccagaggcagttaaccctgtagcacttactagactggtgacaactggctggatgtggagaataagtgtcaaaacctggcttcaatgtctatttcttatgtctaatggagttcttatattacagtgtttgtttagctatggttactaatatgtttgttatatttattttcggggagaggatcttgttattgtttcctgagattatttaaaatgttttttctttgatgtatttctgtctttcttatatgtaaggagttataagggttattatattttcatttctggtttttactatacaatggttatctaacatactaagttggtaccctacctacccgtaaaatatgaaatactcagaagtaaagtgtgtgggcaatcagaagcatagccttgaaggacctgacagcagtatgaaaagataaataggccaggcatggtggctcacgcctgtgatcccagcactttgggaggccgaggtgggtggaccacctgagatcaggtgttcaagaccagcctgaccaacatggtgaaaccctgtctctactaaaagtacaaaaattagccaggcgtggtggcgcatacctgtaattccagctactcaggaggctgaggcaggagaattgcttgaacccaggaggtggaggttgcaatgagccgaggttgagccatcgcactccagcggtgaaacaagagtgaaactccatctc

SEQ ID NO: 511 - DNA, 2305 bp, Homo sapiens
gagggaggcagggagagaaagggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggcagtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattattaaaaatgtaagttaaaaaaaaaa

SEQ ID NO: 512 - DNA, 2560 bp, Homo sapiens
cccttcttccctcccttcctccataccaacctccctccctctctggagctcctgctctctccctctccctcctctcccgtgctccctccctccctccctctttccctccctcctctcctctccctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaaaaaaaaaaaaaaaaaaaaaa

SEQ ID NO: 513 - DNA, 1388 bp, Homo sapiens
ctggccaccaagcgcctccgtggacacgcacttcctgcgaggcctccgtgcgcaccttggccgagccgaaccgagccgagtcctgtccttccaggccgttcgcaatggtggatgagttggtgctgctgctgcacgcgctcctgatgcggcaccgcgccctgagcatcgagaacagccagctcatggaacagctgcggctgctggtgtgcgagagggccagcctgctgcgccaggtacgtccgccgagctgcccggtgcccttccccgaaacgtttaatggcgagagctcccggctccccgagtttatcgtgcagacggcgtcttacatgctcgtgaacgagaaccgattctgcaacgacgccatgaaggtggcattcctaatcagcctcctcaccggggaagccgaggagtgggtggtgccctacatcgagatggatagccccatcctaggtgattaccgggccttcctcgatgagatgaaacagtgctttggctgggatgacgacgaagacgacgacgacgaagaagaggaggatgattattaggccctcgaccctcgggcctcgggggggagggccctgcacgccgccaccccctccccgcagccctcaccccgccaggagccactgctctcccccttgccctccggtccccttacctacccgcgcccgtctgctctctctcttcatttctccgtagtgcttgtctttgttccaggaatagcgctccagttacctgctgctggggtcggggctggagcctcactcactcggaagtgcttggaagtgtcatctaccctggccatccccgggatccctcccctgctaatctgaactgtgtcctgaaccccagctattggccaggcccctgttacaaactgcgcagaccacccatagccctgctgctgccacctgccctgctgccaggcttacatcttcccagagaactatgctgccacttcacatccactcaccacatcccacctacagactaccacctttcgagatcaggaccaacctggaaaatgccagagttggctatgccttttcagacattgatttggacagctcaccaacccctgaaggggccgttcagcctggttagttttctacctactccgagtgtcctcccctgccccaccagattgctgcaggggcgcggtgtgcctggcagccaaattgttgacacttcttttttcctatgcactggttttacacagctgtcatttttctttcaaaattgcagcagtcccacagatgtgtgcatttggacaaatagtacttaaaaacaaaacaaacaagcactcagcccagctcctcaatactacctggaaaaagcattggcattattttcaataaatatcaagcactaaaaaaagaaaaaaaaaa

SEQ ID NO: 514 - DNA, 3620 bp, Homo sapiens
agcgccggcgaggcgcgggaggaggagaagcagtggggaggcgcagccgctcacctgcggggcagggcgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctcccctcatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattgtcatttaaaaaaaaaaaaaaaaaa

SEQ ID NO: 515 - DNA, 2283 bp, Homo sapiens
cggccgcgagttgtgactggagccacgatgcacggccaggcgcggtgagaagccagcccgtagtgcctcccgaaggagcccgggcgcagggagggtcgccctgaggacacggaggccgccaggcaggccaagggccgaggtgactgggctggggcggtagggaaggagcgagtgcgcctggctgcctccgcacggagttgtccctctctgttttcgattgacacaaacacttctccaaaagcggggaaacctaagcaacaacagcaatcaacaccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcggccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtctggttccagaaccggcgctccaaggagcggaggatgaagcagctgagcgccctgggcgcccggcgccacgccttcttccgcagtccgcgccggatgcggccgctggtggaccgcctggagccgggcgagctcatccccaatggtcccttctccttctacggagattaccagagcgagtactacgggcccgggggcaactacgacttcttcccgcaaggccccccgtcctcgcaggcccagacaccagtggacctacccttcgtgccgtcatctgggccgtccgggacgcccctgggtggcctggagcacccgctgccgggccaccacccgtcgagcgaggcgcagcggtttaccgacatcctggcgcacccacccggggactcgcccagccccgagcccagcctgcccgggcctctgcactccatgtcggccgaggtcttcggacccagcccgcccttctcgtcgctgtcggtcaacggtggggcgagctacggaaaccacctgtcccacccccccgaaatgaacgaggcggccgtgtggtagcggggtctcgcacggtctgcggagttcgtggttgtacagaaatgaacctttatttaagaaaaatag

SEQ ID NO: 516 - DNA, 2416 bp, Homo sapiens
gactgcagagccggggctgggctaggcgcgcgcttggagagcattgcgcgcggctgggcccgcggccggcggctcctcctcccactctgctcctcctcttttttctcctcctccacctcctcctccgcctcctcctcctcctcttcctcctcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagccgggcgggcgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcgtcctgccccgcgagcgcccggggcccggagcccggcctgggggctcagccgagctcgggcggggccggggccgcggtggcgatgcaccgggcccgttagcgccaggagcgccaggcagctgaggcggggggcaagccctccctcggaggagccgcgcccccggccccgccggtcccgccgcgatgctgttccacagtctgtcgggccccgaggtgcacggggtcatcgacgagatggaccgcagggccaagagcgaggctcccgccatcagctccgccatcgaccgcggcgacaccgagacgaccatgccgtccatcagcagtgaccgcgccgcgctgtgcgccggctgcgggggcaagatctcggaccgctactacctgctggcggtggacaagcagtggcacatgcgctgcctcaagtgctgcgagtgcaagctcaacctggagtcggagctcacctgtttcagcaaggacggtagcatctactgcaaggaagactactacaggcgcttctctgtgcagcgctgcgcccgctgccacctgggcatctcggcctcggagatggtgatgcgcgctcgggacttggtttatcacctcaactgcttcacgtgcaccacgtgtaacaagatgctgaccacgggcgaccacttcggcatgaaggacagcctggtctactgccgcttgcacttcgaggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggcggccgaggaaacgtaagagcccgggccccggtgcggatctggcggcctacaacgctgcgctaagctgcaacgaaaacgacgcagagcacctggaccgtgaccagccatacccgagcagccagaagaccaagcgcatgcgcacgtccttcaagcaccaccagcttcggaccatgaagtcttactttgccattaaccacaaccccgacgccaaggacttgaagcagctcgcgcaaaagacgggcctcaccaagcgggtcctccaggtctggttccagaacgcccgagccaagttcaggcgcaacctcttacggcaggaaaacacgggcgtggacaagtcgacagacgcggcgctgcagacagggacgccatcgggcccggcctcggagctctccaacgcctcgctcagcccctccagcacgcccaccaccctgacagacttgactagccccaccctgccaactgtgacgtccgtcttaacttctgtgcctggcaacctggagggccatgagcctcacagcccctcacaaacgactcttaccaaccttttctaatgactcgcaacccctcaccccacaatttctttaaaaaagaaattatctttagttgaattccaagtgtattttaaaatagaggctttgagcaactaactaaccacattttaggatctcgcctggaaacagaggtaaaaaaaagaagtgtgcgcccggctaatgcagcggtgtggaccgaggaacaacttggaagatctacctgcaacacaacatttgtgtcactgtacagttttgtggactgagcgaggaaaaacaacaaataatttaagttggctagagcttctgtattttcaaagactgccacgtgccttaggaatactgttttatctccatactttggatgacttgttcatttttctctccctctttttctctgtatatttatgaccagagcaaaaatgtaaaaaacaaaaaaaacaacaaaaaaagtttgttactttgaatagtcctaaaaag

SEQ ID NO: 517 - DNA, 2413 bp, Homo sapiens
cgcagcgcccagcagcacccggagtcgcttggacgccggttcggggctattgcggggtggcgtcgctgggcccgggaaagttcgggactggagagtggcgacgccgggcggcgggacccatggaggcgcgcggggagctgggcccggcccgggagtcggcgggaggcgacctgctgctagcactgctggcgcggagggcggacctgcgccgagagatcccgctgtgcgctggctgtgaccagcacatcctggaccgcttcatcctcaaggctctggaccgccactggcacagcaagtgtctcaagtgcagcgactgccacacgccactggccgagcgctgcttcagccgaggggagagcgtttactgcaaggacgactttttcaagcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccgatgagccttccttggcggaaatgggcccggccaatggcctctacgggagcttgggggaacccacccaggccttgggccggccctcgggagccctgggcaacttctccctggagcatggaggcctggcaggcccagagcagtaccgagagctgcgtcccggcagcccctacggtgtccccccatcccccgccgccccgcagagcctccctggcccccagcccctcctctccagcctggtgtacccagacaccagcttgggccttgtgccctcgggagcccccggcgggcccccacccatgagggtgctggcagggaacggacccagttctgacctatccacggggagcagcgggggttaccccgacttccctgccagccccgcctcctggctggatgaggtagaccacgctcagttctgacccaggcccggctccaccctgcacctcacacgagggagctgcccctgggtgggcggctcggggctgctggggtttccgaggaagtggggccagggcgtcaagggagggctggtgccttcggagcctcccactgccgaccgcacagctccctctctgggggctgagggacccacctggcccctcctctgacacagggctggcccgccaggtggcctcccagcaagccagccttttttgtaagcaaatttctcccctttattgaccaattaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtctcctcctcaccccaccccaggcccttggtgtccaggctgcacccacagatgtctgttgccaaacagcctgccctccctgccggagccggctctgccagccccagattgggaagtctccccgctggagaagggtggggctcctctgagcctgccctgcctcctccatcagatcctttgggaagaagtttctgggagatgcccgcagctgtgcgtgccccagacacaaaggctggcctgtgtgtaagtcaaagtcactcccgcaaacctgaatctcgagctacctattggttctgtgaatgttctgtgtcttttatttattctcgggtgatcagctctttccaagacttcaataaatttgtcagttacagtcaaaaaaaaaaaa

SEQ ID NO: 518 - DNA, 1913 bp, Homo sapiens
ccggagagcgagatcaaagggactggaaacagactggggactggcggggggagggggccggccagcctgtggagtcctccctgagaagcggagggcccggcttccaccgtgactccagcggcctgcttggggttttaattattattttgaaatttctgaatcgagctagagcgagagagcgagagatctccgtagactgcgactcgctggctttcgctccgagatgatgcagagtgcgactgtccccgcggaaggggctgtcaaggggctcccggagatgctaggtgtgccgatgcaacagattccccagtgcgctggctgcaaccagcacatcctggacaagttcatcctgaaggtcctggacagacactggcacagctcctgcctcaagtgtgcagactgccagatgcagctggcggacaggtgcttctccagggctgggagcgtctactgcaaggaggacttcttcaagcgcttcggcacaaaatgcacggcctgccagcagggtatccccccaacccaggtggtccgcaaggcccaggactttgtctaccacctgcactgctttgcttgcatcatctgcaaccggcagctggccacgggggacgaattctacctcatggaggacgggcggctggtgtgcaaggaagactacgagacagccaagcagaacgatgactcagaggctggagctaagcggccccggaccaccatcacagccaagcagctggagacattaaagaatgcatacaagaactcccccaagcctgcccggcacgtgagggagcagctgtcctcagagacaggcctggacatgagggtcgtacaggtttggtttcagaacagaagggccaaagagaaacgcctgaagaaggatgcagggcggcaccgctgggggcagttctataagagcgtcaagaggagccggggcagcagcaagcaggagaaggagagctctgcagaggactgtggggttagtgacagtgagctgagcttccgagaggatcaaattctctcagaacttggccacaccaataggatttatggcaacgtgggggacgttacaggcggacagttaatgaatgggagcttctccatggacgggacaggacaatcctatcaggacttgagggatgggagcccctatggaatcccccagtctccatcctccatatcgtccctgccatcccacgctcctttgctcaatgggctggattacacggtggacagtaatttgggcatcattgcgcatgcagggcagggagtaagccagacgctgagagccatggctgggggacccacctctgacatctccacaggaagcagtgtaggctatcccgactttccaactagcccaggctcttggctcgatgaaatggatcatcctcctttttaaacttctctcctccccaccctacctgcccccctggcttgagagaatatcttcaaggatcaaaagagacttgccttttaaggatcgaaagtacgccaatgtgaatttccattattttcaatggaagtcctccgctgattcctagaaggctgtgagaccacactagggcattgtttccctggggaagcagtgggagagcagactcatctcagaacacagcacagggggtaatggcctagagctctagggacactggcttgttgggtctctcccctgctgttctgcttaggggcttggctgctcagtgctttggtagcacaaggtgactgtgataggcccccttggcctttgggaactttgctccaactggtgtgtctcacacaatgcctcccaaaacactgctctcaccagaactgagactcctaaggtagaggcctcacagcccttgagtaaaataaaagtgatttctggaccatcaaaaaaaaaaaaaaaaaaaaaaaaaaaaaaaaaaaaaaaaaaa

SEQ ID NO: 519 - DNA, 2084 bp, Homo sapiens
aaccaggtacaagctaatactcaacaatactgatgccttgttttttttgctctgtccggacagcaacgctgtagccaatttagatatgctataaatttaagaggttgccatggccacggtgcgcccattggccgctgggccccctacgtgcagcgccacgtcaccaaatctgaataaggatgcgcgaattacgcggcgaccagacaaagatgaggatccggaccgcttgaaagtgggggaaagtgccggcgcctccgccaccggggaaagccgctccgcagcgccgaggccagcagccacccgagatacctggggaagcccggaacaggcgccggggcgtgcggcccgtggcatgaggttgtgaacgccacccgccccccaccaccccactccgggcagcccagcgccaggccagagattgcccaaggactggaccggctgagtcttggtccggaccagactcgccctgcagctgctgagacaagaggcgaagggcagcggagggcccggcaggcccgagggccaggggcccaaagggagggcaaggcggccgaagccgccggggcgcggggctatgatggtgcactgcgccggttgcgagcggcccatcctcgaccgctttctgctgaacgtgctggaccgcgcgtggcacatcaaatgtgttcagtgctgcgagtgcaaaaccaacctctcggagaagtgcttctcgcgcgagggcaagctctactgcaaaaatgactttttcaggcgctttggcacgaaatgcgccggctgcgcgcaaggcatctcgcccagcgacctggtgcgcaaggcccggagcaaagtctttcacctcaactgtttcacctgcatggtgtgtaacaagcagctgtccaccggcgaggagctctacgtcatcgacgagaacaagttcgtgtgcaaagacgactacctgagctcatccagcctcaaggagggcagcctcaactcagtgtcatcctgtacggaccgcagtttgtccccggacctccaggacgcactgcaggacgaccccaaagagacggacaactcgacctcgtcggacaaggagacggccaacaacgagaacgaggagcagaactcgggcaccaagcggcgcggcccccgcaccaccatcaaggccaagcagctggagacgctcaaggctgccttcgccgccacgcccaagcccacgcgccacatccgcgagcagctggcgcaggagaccggcctcaacatgcgcgtcatccaggtgtggtttcagaaccgacggtccaaagaacgccggatgaaacagctgagcgccctaggcgcccggaggcacgccttcttccggagtccgcggcgcatgcgtccgctgggcggccgcttggacgagtctgagatgttggggtccaccccgtacacctactacggagactaccaaggcgactactacgcgccgggaagcaactacgacttcttcgcgcacggcccgccttcgcaggcgcagtccccggccgactccagcttcctggcggcctctggccccggctcgacgccgctgggagcgctggaaccgccgctcgccggcccgcacgccgcggacaaccccaggttcaccgacatgatctcgcacccggacacaccgagccccgagccaggcctgccgggcacgctgcaccccatgcccggcgaggtattcagcggcgggcccagcccgcccttcccaatgagcggcaccagcggctacagcggacccctgtcgcatcccaaccccgagctcaacgaagccgccgtgtggtaaggccgccgggccgccccccgcgctcggcccccgggggccccgccccgaagcagcctcctgaaaccaaaacgcccgacgcagacgcggtgggagacgtgggtgtccctcgggggttctctctcgggtccgcactcaactggcagctgctcctcggctgggcgccgagggggggccgacccccatctccaccccgcgggctctccaggagcctcagcccaccgccagtactctcccagcaaccgcgagcaatttcttgggaccaaagtcaatactccggagggtcaagagatttcgagcacgc

SEQ ID NO: 520 - DNA, 3377 bp, Homo sapiens
atgtactggaagcatgagaacgccgccccggcgttgcccgagggctgccggctgccggccgagggcggccccgccaccgaccaggtgatggcccagccagggtccggctgcaaagcgaccacccgctgtcttgaagggaccgcgccgcccgccatggctcagtctgacgccgaggccctggcaggagctctggacaaggacgagggtcaggcctccccatgtacgcccagcacgccatctgtctgctcaccgccctctgccgcctcctccgtgccgtctgcaggcaagaacatctgctccagctgcggcctcgagatcctggaccgatatctgctcaaggtcaacaacctcatctggcacgtgcggtgcctcgagtgctccgtgtgtcgcacgtcgctgaggcagcagaacagctgctacatcaagaacaaggagatcttctgcaagatggactacttcagccgattcgggaccaagtgtgcccggtgcggccgacagatctacgccagcgactgggtgcggagagctcgcggcaacgcctaccacctggcctgcttcgcctgcttctcgtgcaagcgccagctgtccactggtgaggagttcggcctggtcgaggagaaggtgctctgccgcatccactacgacaccatgattgagaacctcaagagggccgccgagaacgggaacggcctcacgttggagggggcagtgccctcggaacaggacagtcaacccaagccggccaagcgcgcgcggacgtccttcaccgcggaacagctgcaggttatgcaggcgcagttcgcgcaggacaacaaccccgacgctcagacgctgcagaagctggcggacatgacgggcctcagccggagagtcatccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcaggtacagtgcgggcaggtgcactgccggctgccttacaccgcaccccccgtccacctcaaagccgatatggatgggccgctctccaaccggggtgagaaggtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccgccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtggcaaccatgtggtaagtggccaaccaagccctacccagggtcacccaacacactctgccttgagcctctcctcagggtctattccttgcgtggattatgtggccgtagcatgttacagttcaaacatgtctccactaccctgttaagagcagcctgggaacgtacaggccatcaagactatttatttaaatacaaaaaaaggggaaaacacacacacggaaaaaaaattgtaagcactttttttgtaaaaccaatgtctgttttgttacatacctttcatgtcgtgctttgtaaatgtcttatttgtgtaataaagttaatgcaagtagaagtgctggcactgaaatccagaaaaaaaaaaaaaaaaaaa

SEQ ID NO: 521 - DNA, 11878 bp, Homo sapiens
gatccgcccgcctcagccttccaaagtgacgggattacaggggtgagccaccgtgcctagccggaaaataattttaaataacaccggaagttcaaaaaatttaaggagtgaaagcaagtaaccataaaaggcaagaggaaactcagggaggggaaaggcaaatgtcttcattgcacatattttattttgtttcttaatttgggtggttgatacatgggtacttattcttctgtaagcctaaaggtttcataattaacaaatcacctgtacgaagaagcagatggaaaagacctgatgatactgcagcttctctaaagacctagggttcacagtgttttaattgactgcaaggtaatgaggctgtcttaggagacaagttctaccacttcagcactttcagatatccagattattgtgcttatttcagagtgccaaattttaagaagggactaataagcaatctgaaaaacatactacctcaaaggctaccagggttgtgaaagatttagatcatgccataatattaaaggcagcagggatatttatctggagataaggccaggagatggtaagagaaagagtaatatccagagtaggtgtctttaaatatttgtgaaaggcttccctgcaacggaatgtagaaaaaggcactggtgttcactcataatgaattttctcattattgaaaggctacacaaatggcacggactaccaaggaaggtagtgagtttcctctgcctgggagaacagttttctttggcaggtagttccgactccacgggctaaaagttccttctaatttaagactctgtatattcataacaatgatagcttcaggtaagtcagatgcatgacttatatcattttgaagttggaagcaaagaagaaggagagttttcttagagcttttcatatttgaaggactaaggaacacaggcagacatctgtcatgtaatttccaggcatttaggttactagtactatgagcaagttaactttgtcctaagccctaccatttggagaatatattttgaatgttggctttcaatatgttaaggttgaacattaaatatttttgatatgattccaaaggaaagagtactagcatgcttatgtgtttattatttgtatctatacataggctcactatatgttgtagcccttcagagtattttataagaattactgtgatctcaaatagtaatcatactttccctcagcctccttcctagcattgggcataatattttagaaaggtaagaaaaaagagtttttattactagacttcttctaatatgcaaactaggtcacccaaagattaggaggaaactggtgtgatacgtggagagtttcacgtttcctagttacaaatatgcttagtaagacatttgtaataaagcagactgtccttatactgaagtcaaagaataaagatgagtgatttttttccccacacactgcatccagatacaatcactgttcacatactctttcagataagtgaattatgatttttatgttgtgcagagacagagtaaactattgctatttcttccaatcagtgtactaggaatacccttccatattaacatcatatttattgccacatatattgagcatagcacaatttatttagcttccaatttttcactattataaaatgctgccatgagcaacattgtatatctaccttgcgtgcttgttcaatagtttcctcaggataaatttctggaagggagattgttgagtccaaagataaaacatgcatagggcctttatacaaacatgaaatctctttgcctttgagaaagttcatacaactttattctgccaggagctacgtacaagagttccttttccccaactcagaagaatcctgaatactgttactcttttacatcctttacaatttaatagttagaaaagaaaatctcattgattttatttctgtttcttatattatcaatgagcttgaacaaattagtttattttttcatttttaagaccgtatgtttttagctcactcttctgttgggttattttctctatatcttactgatatttattaatcctatctgtcatgttaacctttcacggttcatcaatttcctttttattttttccacacagaacatttatatttctatgtgtttaaatctcccagtcttttgatagttttggcctttttttttgttttgtttttctttttttgagatggagtctcactctgtcacccaggctggagtgcagtggcacgatctcagctcacttcaacctccgccttccggactcaagcgattctcctgcatcagccttctgagtagctgggactacaggtgcgtgataccacacgcagctaatttttgtattttttggtagagacggggtttcaccatattggccaggctggtctcgactcctgacctcgtgatccacccacctcggcctcccaaagtgctgggattacaggagtgagccatcacgcctggcctttttgttttgttttgttttgttttttgagatggagtcttgctctgttgcccaggctagagtgcaatggtgcagtctcagctcactgcaacctctgcctcctgggctcgagtgattctcctcctcagcctctcgagcagctgggactacaggcacctgccatcatgactggctaatttttgtatttttagtagagatggggtttcaccatgttggccaggctggtcttgaactcctgaacttgtgatctgccacctcggcctcccaaagtgctgggactacaggtgtgagccaccacgccgggtctagttttggcctttcttatgcttccctatctagagagtatttcaatgttgccttttgttttcttaaacttttattgtttcaattatttacgcctaaactttaatttatctggcttggttcatgggagatagggttttatctatttttttctctctttcaaatgataaactatcagttttccctaaatcagtgaaacatgctttcccaataaaataaaatcccatctttgtcatatacaaaattattatatttggctttttgtctgggctttctaaaggtttcattctctgcattagtattttgcttttccattatatctacatggcctgattttagcttagtttatgatttagaagtcaaaaaatttaaagtagttactcagaaaatgttaactcttgttggaggtttgcaaacaagaaggaggaaattttgtcagtgaggagagtcaaaaggacttatacttgattctgaagctgggtagcattcatgccagaaggaatttcctgatgtctggaatcttaaactatattttgctctaccagttagttacatgatactttgtttttgcaaacctccttctgcttgattacctgtggatgatctttccaagaagctgcttaacaagatagttattctgctgtttatattataccttcttcatgtttatttacaaagtttgagtgtttttttttttcaatcaaaagatggtgtttcttttgttttacaactgcataggttccattcaatatataacttattggagacaaaaagatactttgaagaaactctgggaatcatagtgcaacatgttttaggttatatgtagtcctctggcgtatgtgtcttctgggtcccataagggaaaaaggccggtggcagtggttcccccttacacattggagaatgtttgagtaatgtcatcctatttgggtgagactagtgttagtagtgacatctattgttccagagcctgtgggcagaactgtggagtttggggtgtggtctataggtatctctgagtctcactaacactccagagaacagggatgtggaggaggctgtgacttcccacttgtcttactggtggatacctaagtcttgtcccagaaacattccttagctgctacttttcagcctcctgctcaaggctatataccccactagattattaattttttattcttttagttttaatcactcttgagagtatactttgccaaccttctatttttgaatgccaggggcagggtgtagttctgaagtaaggccagctttttcttataaattctttgcagcttccttttatttcacattaatcagccctgattgccttgtgccatcaaggccctaccaccagccttgaacagacttatgcccctgatgttttcctggcctcatatccctgatcccaaaatgttctcatgctaagtttttatcccttcgcctctctttcctctcatgacagaattgtttggagtgatggaaaaaaagtgatacagtattttaatgaagaaacactctcttttttttttttttttttttttgagacggagtctcgctctgtcgcccagcctggagtgcagtggcatgatcttggctcactgcaagctccacctcccaggttcactccattctcctgcctcagcctcccaagtagctgggactacaggcacccgccaccatgcctggctaattttttgtatttttagtagagatggagtttcactgttttagccaggatggtctcgatctcctgaccttgtgattcgcccgccttggcctcccaaagtgctgggattacaggagtgagccactgcgcccggcccatgaagaaacactctctatggtcaagttttatcacctgtcagggaattcaaacacaggcatattagctactggaagcattctgggcagcctagacttacttgccctgacctggatgtaaagctccacttgccctgaatttgcttcttttatttctgcagtagagtggacagcagggtggttagcactttacattttgtgaactctcatcagtggatgtgtttgtatttaattctacttaaatattatgagtttttttcttattaaagacctgaccttaacatgcttcttagggaatagcctatgtattcaccaagagaaattgaactcagcaggttaaaatctgactggaataactgaatcaagaggtttgtagaaagctttaagttctcagtagggattttagtcatttgaacaaggatttgaaataagtccagcaggtgcctaagaatacatttagtagtctttttttttttttttttaagttctgattaaaagagctttttctgcttttccttttgtcctaaataccagtagtaaaaccaaggagatttctctggaattcttgagggcccttccccaccttttctggggaagatgctgttttagtatagaattggcttttatttttatttttaaaaaatctaatggagtttttggggtacttttgtttgggctttgttgttgttgttgttgttgttgttttgttttgttttgttttgtttttgagacagagtcttgctatgtcgcccaggctggagtgcagtggtgcaatctgagctcactgcaacctctgcctcctgggctcaagtgattctcctgcctcagccatccgagtagctaggattataggtaccaaccaccacggccagctagtttttgtatttttagtagagacggggttttaccatgttggccaggctggtattgaacccctcacctcaggtgatctgcctgcctcagcctcccaaagtgctggaattacagacatgagccacagcacccagtcaaatccaatagagtttaataattgcattcaaggggtaaccttaacgtttgaccaactcaaattcaacaaaccaaaatcccttaagcaattggtcccctttcctacttaaatagaattggcttttaggtaaatcaccagagagctatcaactgagcaagaaaaatgaccactgttatttggactaaaatgtttcttttctgtctatagaacttttataaaagctgagttacatttatgcggtgcttgtgtggtagtgtgattgaggttgcattcattttttaactgagttgataatgtgctcagaagctggtgtgtaacctacctacttctgttgcttttctccctgctcaggtgtggtttcagaattgtagagcacgccacaagaaacacgtcagtcctaatcactcatcctccaccccagtcacagcagtcccaccctccaggctgtctccacccatgttagaagaaatggcttattctgcctacgtgccccaagatggaacgatgttaactgcgctgcatagttatatggatggtaggtatcccaacatttaacagctgtctcccaggcaatcagcaactggtaacttctaatattagattattgatacaattcacattttgaaatattacctcagtagtagctgaaaaatattgtggggggtgcagtagagagcaaaattatccaaacatttttatttctgtgattacattttaaggaagaagtttaatactcactttgcagctaagatgcaaatattaataatgactcaatgcttgatctttacttagaaattttttgtttgtttttaccggtaaatatttaaatactttatttcctgtgatcagagcaagtgttcactcagatctttagatgggagtttaataagttttgttaaagagttgttttttatagaagaaaatcatacatttagaagagtgcatacgtaataactattcagcttgatgaattaataaaatgaatgtatccatatagatattgcccaaagtagcagatataattagcatttcagaagcctctcttatgtctccttccaattattatccttttctcccaaagtaacatggcactgatttctaaaaccaccctttagttttgccctttttgaaccacacagaatgtattttgtgtctcacttctttcaattacattgtgagattcacctatattattgtgagaatctgttatttgttttcattgttatatagaaatccactgtaggaatataccacaatttatccatttcctggttaatagatatttgtgttttttccagtttgtgcttttatgaatatgctgctatggactttattgtacatgctttttgtgcacattaattcacatttctactagatatgtacctgggagtgggacataaggtcatgggctacacatatgctcaacttcagtcattctgacagatagtttttcacagtggttgaaccagttacaccttgaccagcagcaaggttcaaggtgcttcacatcctcaccaacacttggtatggtgtacttcctgatattagcaaatgtgatgattgtgcagtgcaatcttattttaatttgcctgtccctgatgactgagcatattatcatcaggtatttgtatattctcttttgtgaagagctgtacaagtctttttgtctttcggcctactggcttgtctttattatttatttaaatggattcgcttaatttcttcatgtaatctgcatataaagctttttgataattgtatgtgcttagaatattttctcctacttagttgcttggctttttctactctcttaatggaatgtttcattgagcacaagttcctaattttaatgtagtttatttcatcatttttccttcatgagccatgctttttttggtgacatgtgcaagaaattgtttatactcaaagataatgaagatatatcttctatgatatcatctagaaactttgttttacctttgctgtgtagatttacaattcatttggaactgaattttgtgtgtggtgtgaggtagaaagtgaagcttttttgttatgttgatgaaaatagaaaatgtccagcttctctgtagagacatatttgccataaatcaaatgtccgtatgttgtgtcaatttctgtaccttctgttctattttattggtctatttatttttgtgttgctacttaatcattctaatcatggtaggtctataatttttaatatatgataatgtgtttctattttgttgttattcaagtttgtattgcccattcttggccctttatgttttcataaaatttacctacttgtctatttctaccccaaaagggaaaacaattaagattttgatacaatctattacagcaaatatattgatcagttttaggaaattgccatcttaacagtattttcttccataccatgaactttagcatgtctttccatttgtttagatcatctttaaatcatctcatgatttagacttttctgtttagtaatcttgcacatcttctgttaagtttatctctaagtatttctttgaatcagtggtagtggtatatctctataagtagaaatctggattggtagttattttctttcagcacttggaagatatgattaccttgtcttctgattttcattgtttgtttggcatatggatagctaattaacctggccccatttattggtaaagtcagctattgaccttcttgctccttcgaaaataaacgtcttttttcctcaacttttttctttgtgtttgtcttgaaaaagttttaccatactgtgcctgggtgtgcttcttgaatatgtagtttgatgtctttcattatggaaaattctcagcttttgcctcctcaaatattgtttttgctcctatgaaaaaattttcttgttttcttctgaactatttttctagttcactaatgctctctatatctaatatcctgtaaaaaaatcatccaccgacttcttaatttattatgtttttcagttttaagatttccatttatatgctgaaatcatccattttgtcactttatccttatttaaattgttatactaaagttcaggtgtgataactccaatatctggatctttggtgggtctattctgttttcttaattttcctctttattttctttcaagtcatgtcttgttatttgtcttcttatttgctattgcatttcagatgttgggtatgagtaactaaaaataatttgaggctgtggatgatatctttcactagagaagattagttttaccccccaggtagtcagaatagggtgaaatcaacttaatccaatcaggcacaaatccttaagagggctggtatatttttgttttactactccttggagttagccctttggaatcacaaatgaatccctgttttgttttgttttctgttgttgtttttaactagggcttctcctcttcagcgggccctgctctttaatttttgtttctcaccactctgccaaagtctaacttctgaatgctctgctaaacttcttggcctatcagacatttgttttgttttaaattgtcactatccttgcgggaggaaaagcatcctcattttctttccctccactctgggactttgtaagtcctcactacttaagtgtctttcagatgccttcaaacagattttaaaaattttgtccagatttcctagttggtctcagagaaaggtttggtttgaagcaacatagcccttgctgaaagcagaaacttcattttaagttttggttagataaaaaatcagagcctgtactgttgttgccatttacttatactagcattaaaattgtgtgtgttcacatgaaacacagtagtgttgcctgagtccagtgtgttttgatgtatgcttagggaggaggtaattaaacattaatgaaagaaacttggggaagatcatcctatacaaacaccttcatgagaaagctagcagcagcatctctgaagaggaacccatgtctttctagcttcagggtgaagtgcagtgaatggggtatggatggaggacattaaaatggcaaaatcttgtggccccaaataaagatttgggggtaaaactgttcctggactctcactatgctgaataggttaatgcttctgctgaggtcagtggaatgagtgtagcttggtgccctcagctataatgagtgatgaaaacattgccttggattgtttttgtttgtttataaatcagttttatgcaccctacaaaactgatccacaaatttctttctattttgtagctcattcaccaacaactcttggactccagcccttgttaccccattcaatgacacaactgccaataagtcatacctaattcttttttcagggatagacttgattaaggatataaatttgtcatttattatgtataaaataccattgaaaagatattactgttaattttttatttaacacctaaagcatttccaacatcactttgctgcccaggtatgtatctatagttggcctgcaagacacttttattaattcttcattttttgtaaaacttatgtttacaagaagaaaacaaatcaaaacattttttgtattgtctggaaatagttcactctagtgtgtatctgttaatttatttgtcatcaaaagagcactttgcctaaaagaaaggactgacaagtgtgcaaaatgtttacaatcttttgtgaaattgtagtttatcattagtttgtatctgtaagttattgtaataaatattacctgtattttttgttatatacaactttatactttgaagcttgtatctgtgaatttgcaactgaaatttattttgccaatgttttctgaatgaactgaataaagcttctgttgtagcatgccatgcaaacacattattgtgtttgtggttgatgaattatggctgtaaataacactatagtttaataagcccaccattctgagtttattaaacattttccattcttgtgaaaatttcaaccagtttgtcctttttgtgtgttttcagcagtaagttgactttagtctctttaaaatctaacaactaataagtttaaaaagtattgtgttttgagctgcattgtatgaatacatttgagtaggaaacatattattcaaaaaaaaaaaaaacacagtaaaacatttaatttggcaaaaattgtcttttaggccagctaataaaatcaatgtgaaagagaaggcagaacacttttcagaatggacttcggagggtattacaagccagaaatgaaatatgggccataatatatttcttcaggagtgaaaaaagagaactaaaagtttctagagcaagaactctttgcattttcttcttggtgaataccctttagggatggtgattctgagagctgaaatcttaaacctcaggactttatcttatgtggcagtggacttacaaatttttgaatttaaagaatttagtactcactttttgtctttttatatgccagttggggaagaaaaaaggtaatgagaaaaaacttttagaacttaggtttaagtctgtgtttaactgagcagatttgcatcaggctgaggactggaaataatagcagagtatttgtaattttattctagtaatcataaatacaaccagaaagtaatcatatggatataagtaacttatctgcctgaaaccagaagcaacaaacctgcttcattatgggagaaaggggagggattttttttttttttaaaccggctactctattttaaatccctttgtagccagaagtcaacccatctaatcttgagcctgatgctaatctctgtgggtttttgtctacctgtcccaggcatgaagtgatgaggtcagctttacctttacctgatgtctaggaaagcttttgtagtatagccaagctctgcactgttagcagtttacagcatttcccagctgactataattggcatcccttagcttgggaggtggctgattgtgagtattcatttttatttgctgtctttttcctgtgctcatcatcctctgactctgtacagagagtttttacaaaatatatcaccaccctttttagttccaaagatgaatgcccaaagttgaagtaaaacttcctaacaaagaggctcaaagctatcaaaatagatgagatttatatatcctgaatataaaactgttaatcatgaaaagagatagatgtgaaagtactaaaaatatgatatgtgatagaagcttctgactttgctatctctagccagagatc

SEQ ID NO: 522 - DNA, 1164 bp, Homo sapiens
atgctgaacggtaccactctagaggcagccatgctctttcacgggatctccggaggccacatccaaggcatcatggaggagatggagcgcagatccaagactgaggcccgtctggccaaaggcgcccagctcaacggccgcgacgcgggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacagaaggttctctgtgcagagatgtgcccgctgccaccttggcatttccgcctcggagatggtcatgcgcgcccgagactctgtctaccacctgagctgcttcacctgctccacttgcaacaagactctgaccacgggcgaccatttcggcatgaaggacagcctggtgtactgccgcgcccacttcgagaccctcttgcaaggagagtatccaccgcagctgagctacacggagctggcggccaagagcggcggcctggccctgccttacttcaacggtacgggcaccgtgcagaaagggcggccccggaagcggaagagcccagcgctgggagtggacatcgtcaattacaactcaggttgtaatgagaatgaggcagaccacttggaccgggaccagcagccttatccaccctcgcagaagaccaagcgcatgcgaacctctttcaagcatcaccagctccggaccatgaaatcctactttgccatcaaccacaacccggatgccaaggacctcaagcagcttgcccagaaaacaggtctgaccaaaagagttttgcaggtttggttccaaaacgcacgagccaaattcagaaggaaccttttgcggcaggagaatgggggtgttgataaagctgacggcacgtcgcttccggccccgccctcagcagacagcggagctctcactccacccggcactgcgaccactttaacagacctgaccaatcccactatcactgtagtgacatccgtgacctctaacatggacagccacgaatccggaagcccctcacaaactaccttaacaaaccttttc

SEQ ID NO: 523 - DNA, 6101 bp, Homo sapiens
agccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacagctgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactctgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctattcattgtgtatgcttcatcacctatattaggcaaattccatttttttcccttgtgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttgtccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcataggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgtaaatga

SEQ ID NO: 524 - DNA, 4014 bp, Homo sapiens
gtgcgggggaagatgtagcagcttcttctccgaaccaaccctttgccttcggacttctccggggccagcagccgcccgaccaggggcccggggccacgggctcagccgacgaccatgggctccgtgtccaaccagcagtttgcaggtggctgcgccaaggcggcagaagaggcgcccgaggaggcgccggaggacgcggcccgggcggcggacgagcctcagctgctgcacggtgcgggcatctgtaagtggttcaacgtgcgcatggggttcggcttcctgtccatgaccgcccgcgccggggtcgcgctcgaccccccagtggatgtctttgtgcaccagagtaagctgcacatggaagggttccggagcttgaaggagggtgaggcagtggagttcacctttaagaagtcagccaagggtctggaatccatccgtgtcaccggacctggtggagtattctgtattgggagtgagaggcggccaaaaggaaagagcatgcagaagcgcagatcaaaaggagacaggtgctacaactgtggaggtctagatcatcatgccaaggaatgcaagctgccaccccagcccaagaagtgccacttctgccagagcatcagccatatggtagcctcatgtccgctgaaggcccagcagggccctagtgcacagggaaagccaacctactttcgagaggaagaagaagaaatccacagccctaccctgctcccggaggcacagaattgagccacaatgggtgggggctattcttttgctatcaggaagttttgaggagcaggcagagtggagaaagtgggaatagggtgcattggggctagttggcactgccatgtatctcaggcttgggttcacaccatcaccctttcttccctctaggtggggggaaagggtgagtcaaaggaactccaaccatgctctgtccaaatgcaagtgagggttctgggggcaaccaggaggggggaatcaccctacaacctgcatactttgagtctccatccccagaatttccagcttttgaaagtggcctggatagggaagttgttttccttttaaagaaggatatataataattcccatgccagagtgaaatgattaagtataagaccagattcatggagccaagccactacattctgtggaaggagatctctcaggagtaagcattgtttttttttcacatcttgtatcctcatacccacttttgggatagggtgctggcagctgtcccaagcaatgggtaatgatgatggcaaaaagggtgtttgggggaacagctgcagacctgctgctctatgctcacccccgccccattctgggccaatgtgattttatttatttgctcccttggatactgcaccttgggtcccactttctccaggatgccaactgcactagctgtgtgcgaatgacgtatcttgtgcattttaactttttttccttaatataaatattctggttttgtatttttgtatattttaatctaaggccctcatttcctgcactgtgttctcaggtacatgagcaatctcagggatagccagcagcagctccaggtctgcgcagcaggaattactttttgttgtttttgccaccgtggagagcaactatttggagtgcacagcctattgaactacctcatttttgccaataagagctggcttttctgccatagtgtcctcttgaaaccccctctgccttgaaaatgttttatgggagactaggttttaactgggtggccccatgacttgattgccttctactggaagattgggaattagtctaaacaggaaatggtggtacacagaggctaggagaggctgggcccggtgaaaaggccagagagcaagccaagattaggtgagggttgtctaatcctatggcacaggacgtgctttacatctccagatctgttcttcaccagattaggttaggcctaccatgtgccacagggtgtgtgtgtgtttgtaaaactagagttgctaaggataagtttaaagaccaatacccctgtacttaatcctgtgctgtcgagggatggatatatgaagtaaggtgagatccttaacctttcaaaattttcgggttccagggagacacacaagcgagggttttgtggtgcctggagcctgtgtcctgccctgctacagtagtgattaatagtgtcatggtagctaaaggagaaaaagggggtttcgtttacacgctgtgagatcaccgcaaacctaccttactgtgttgaaacgggacaaatgcaatagaacgcattgggtggtgtgtgtctgatcctgggttcttgtctcccctaaatgctgccccccaagttactgtatttgtctgggctttgtaggacttcactacgttgattgctaggtggcctagtttgtgtaaatataatgtattggtctttctccgtgttctttgggggttttgtttacaaacttctttttgtattgagagaaaaatagccaaagcatctttgacagaaggttctgcaccaggcaaaaagatctgaaacattagtttggggggccctcttcttaaagtggggatcttgaaccatcctttcttttgtattccccttcccctattacctattagaccagatcttctgtcctaaaaacttgtcttctaccctgccctcttttctgttcacccccaaaagaaaacttacacacccacacacatacacatttcatgcttggagtgtctccacaactcttaaatgatgtatgcaaaaatactgaagctaggaaaaccctccatcccttgttcccaacctcctaagtcaagaccattaccatttctttctttcttttttttttttttttaaaatggagtctcactgtgtcacccaggctggagtgcagtggcatgatcggctcactgcagcctctgcctcttgggttcaagtgattctcctgcctcagcctcctgagtagctgggatttcaggcacccgccacactcagctaatttttgtatttttagtagagacggggtttcaccatgttgtccaggctggtctggaactcctgacctcaggtgatctgcccaccttggcttcccaaagtgctgggattacaggcatgagccaccatgctgggccaaccatttcttggtgtattcatgccaaacacttaagacactgctgtagcccaggcgcggtggctcacacctgtaatcccagcactttggaaggctgaggcgggcggatcacaaggtcacgagttcaaaactatcctggccaacacagtgaaaccccgtctctactaaaatacaaaaaaattagccgggtgtggtggtgcatgcctttagtcctagctattcaggaggctgaggcaggggaatcgcttgaacccgagaggcagaggttgcagtgagctgagatcgcaccactgcactccagcctggttacagagcaagactctgtctcaaacaaaacaaaacaaaacaaaaacacactactgtattttggatggatcaaacctccttaattttaatttctaatcctaaagtaaagagatgcaattgggggccttccatgtagaaagtggggtcaggaggccaagaaagggaatatgaatgtatatccaagtcactcaggaacttttatgcaggtgctagaaactttatgtcaaagtggccacaagattgtttaataggagacgaacgaatgtaactccatgtttactgctaaaaaccaaagctttgtgtaaaatcttgaatttatggggcgggagggtaggaaagcctgtacctgtctgtttttttcctgatccttttccctcattcctgaactgcaggagactgagcccctttgggctttggtgaccccatcactggggtgtgtttatttgatggttgattttgctgtactgggtacttcctttcccattttctaatcattttttaacacaagctgactcttcccttcccttctcctttccctgggaaaatacaatgaataaataaagacttattggtacgcaaactgtca

SEQ ID NO: 525 - DNA, 2228 bp, Homo sapiens
tcagcccacttccggggagggaggcagaggaacccctccccgccgctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaaaaaaaaa

SEQ ID NO: 526 - DNA, 1274 bp, Homo sapiens
cagcgggagacggccacgagattcccccatctctttgaatataattttagattgagattcagattaaatccgaggggaaaacactttatgaggctgaaagctgtgtcgttgccagagacagggttatgagctatcaaatgcaattacattaagacagattatactgggcaaattgagccatttagaaggtgagaatcaaagaaacggctctgatcctcttttcccccttctctctccctctccctctctctctaaattgcagttcgtagttccttccaattcggaggcacaaaagtaggtgagactgcttttgtatctgcgaagtgcttcactcctgaatgtaattctagctgagtgcaatctaggttaagagccggacaagcgggtaattagagcccgctagctgcccgaggaccggccgccccgccaaagcgcgccccgagtcggcgcccttctcccggccgagcctagctgcggctggacacggagcgcccgagatgatggtgctggacaaggaggacggcgtgccgatgctctccgtccagcccaaagggaagcagaagggctgtgcgggctgtaaccgcaagatcaaggaccgctatctgctgaaggcattggacaagtactggcacgaagactgcctcaagtgtgcgtgctgtgactgccgcctgggcgaggtgggctccaccctctacaccaaggccaacctcatcctgtgccgacgcgactacctgaggctctttggcaccacagggaactgtgctgcttgcagcaagctgatcccagccttcgagatggtgatgcgggcccgggacaacgtgtatcacctcgactgcttcgcctgccagctctgcaaccagagattttgtgtgggagacaaattcttcctgaagaacaacatgatcttgtgtcagatggactatgaggaagggcagctcaatggcacctttgaatcccaagttcagtaacgcccggcgcctggcctccaggcccgtctgtccatctgcccgcctgcccacctgcctggccggccagccagccactctaccagtgcaggctggccagccgctctcctgccacattagaacttctccgtcctcgatgggagggatggcccttcctcctccaccaccgcccgtctgtgtgtgacccctcctggggccaggccgggcctgtacagtctgtcttctgtatataaatgggaacatttattttatgagaaatgtaatgcgattttattactggcgtggattaaacttatgaatgtttccggg

SEQ ID NO: 527 - DNA, 2303 bp, Homo sapiens
gaattcgtccaaactgaggatcacaagtctccacattctgagtaggaggatgagggtctgagttaggatttgggtcctgcagggcttgctaaggaatcccctgatggcctaggattccacgcagagcacatctggtgtgagagagctcgctgcaagggtgaaggctccgccctatcagatagacaaccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagatggcacaggcaccaggtgctagggtgccagggcctcccgagaaggaacaggtgcaaagcaggcaattagcccagaaggtatccgtggggcaggcagcctagatctgatgggggaagccaccaggattacatcatctgctgtaacaactgctctgaaaagaagatatttttcaacctgaacttgcagtagctagtggagaggcaggaaaaaggaaatgaaaccagagacagagggaagctgagcgaaaatagaccttcccgagagaggaggaagcccggagagagacgcacggtcccctccccgcccctaggccgccgccccctctctgccctcggcggcgagcagcgcgccgcgacccgggccgaaggtgcgaggggctccgggcggccgggcgggcgcacaccatccccgcgggcggcgcggagccggcgacagcgcgcgagagggaccgggcggtggcggcggcgggaccgggatggaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcggctgccagcagaacattggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaaatgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaacagctctgcaggcttaataaaaatgacagactgaaaaaaaaaaaa

SEQ ID NO: 528 - DNA, 5415 bp, Homo sapiens
gctctgtcagtaacacatgtgtaagagccgcggagggagcgagcgagccggctagaggccagcgccgccgccgccgccgcctccgagccgggcagcaacagccccggcagcggcgcaggctccagcgcgccgggcccggccggccgcagcccccgacgcctgggtgcgcctgcctgccggcctccgcaccgtccgccgccgctcccggggctgttgtgtctgcgactgctcccggccggaggtgcagggagctcagccgagccgccgctgccatcccggagcgagcaagcgagcgagcgcgcgggagggaggaaggcggcggcggaggaggaggaggagcgggaggagcgcgggcgggggcgggggcccccgggcgggggaatatacaaagtgaagccacattgccaaacttgcagcagcgattgcagcagttgctgccgctgcgccgcgcctgaagccgcgccgcgcgggccgagggctcctgcagctgctcgcgcgcagtcggaggcggagaaggacgaagactgagactgacacttctgctcccggccgcccggcacttacgcgggggccccccaacccgccccagagcaacgcgatttaaaaaaaaaaaaaaagccgcccttagccccctcctcccctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaatatttaatggtgtttgggtttaaacactgctttttctcttctgtattttgaagaaatttagtttttattgttgttgaataacaagctcactttaaatttgaaggagttgagggaggtggagtgtatatttatttagctctgggccagtaaggtattcttcaaattacttaaccacgccattattggcaggggtacaaagtagtttctaacagggtcctttctataagtcaagaatattctgttaacagcatttcgttacacttctatatcacagtaagtcttttgtgtttataaatacttgagtgtccactattttgtttattctttttctcaatagcaaacaaagccttgggtattgatgaaaagtatgtataaaaaaaaatacggcacaaccatcctgttctcttattgagtttatagcttttgaaggaagtcacaatttctaagtcatacctgtacatattttgaagctcacttagttgtagggacccagagctctttttttatggtgatctttgattggtgaagtagccatttcctggtgacccttaggctcgtgtggttggctgtaaggtgtttattttgttttgctcctacacttctttactgactgcgtttccgtatgtattttgggggaagattctgacttcatttagtcttagtcttgagatactgagttgctggttgcaggcagcagagtgtccaccacagtgcctgcactgcccgcagagctgccctccggaaagcatgcagtataacagctagtgctggaaggaggaaaaccaaataggcctggaggctgaggttgtactgccagcttccttagatgtgagcaaatttcaactacaacttccatcacaggctaataaaaccaggtgtgtgaacgctactattttaaattttcttttttaagatggcattttattttgttccagaaaagcgcctgatgtagaccctccctctgagaatagccgtggagccatgtagagaggtgtagctcagcacatctcaactaccagtcagcttccctttgagaacttctgtgctcacttcctgttttcagagattccagggcaggggaaaaaaaaaatcagttgaacttcaaacctcctagaggagattgtaaaggcatagagttgaggtgaatagttttgttagaaccttataaaaataaaatgcaagaaaataatatgaagaaatcacatatatatgtttgaattagatgtctgtttgaattagatccttggggaatttcttcaaactagttctggttcttatatttgttttttttcctttaaggaactttctgaaggaagttagactgcgatggtaaagggggaaatgggttaatgagattgcaggcattttctatattctttttggcataagcacttatgtccctgatatgtacaaattcaaaggaggtggttaataactttagtaaataatatattgtcgcatttaatgatgtggagggctaaggtcattacggactttaaataaactattatatggctggttcctcaagcactgctgcgtatttaataatgagcttctaaaagcatttcttaagttgcagacctataagattacaaatgtcactcatgttagtataatccacatgcaagtgatgaagccttctctttgatgtgctaaattggagaaggactaatggagctatgaatatacaatagaacatatttaagtagtagtcttgctttaggtaaaacactttcttgaaaccagaggcatttcaaacaataaaacccggctctaatggggatgctctgtgtggatagaaagctactaaaaacactcaggtttattctgatgtgagcagcgattgtgtgcagttcctcccccaatctcaacattgcttaggaaaaaaaaaaatctatgagtttattccacctttcatccattgcatttgtgatgttattagttagcaagatggacactgttctttagaaaggacttatttaatattaaccacgtcatagagcaagatggcccccagtccctacaagcaagtgcaattaaaaataaaagcaaatgttactgagccctgctgaactcctgataaaaaaaattatgtttatggtacatataaatgtctcaatcatgcaaattgtcactcttgttaatgaaacaattttgtaaaaagatagtcctctaaaagggtttaatgttttttacctatctaactgtctaattagatttacacatcccgcaaggcaggggagcctgaagcttttccaaaccaaatcgtttgccactagaaactattttcagctcttcatgatttattaggaaatagtttaacccggactgtagtgtcttataaaatacaaaacgagaaaactgacacaccaaaatgaagtctgtgaaattgtcatcctcttaatattacctgtatttaaattctttcttttgcccttattaacactgatatttgaaacaactaatcatctaaaaggaagctcttaaagggctttaaatgtcaatatagtaagattctaatgtgcactactatttatataaaatatttcttagggcccataaatcatataataaacagtgaacccaagagctacatatggagtctagtgaagagttcccatgtagcctaactaattgtatttaaattgaggagatccaaaaaccccatcacccttcaccccaaagaccccttcacccttcaccagggaattctatcctgggtgctgtcccacctatgaccccttcaagaggccattggaaaaaggccatttacaagttaatgttacttatagctttgttactaagactcacctattgttagtgcagccaagtcacagaagtgcttattgcagttaaatagcaatttgtttccatgaaactgcaattaaagtattactgagcagccattttagattggcagtgctctgaacgcatgttaaacagccagctactcccacttgcagagtctgagatctgactagcagcaaagtgtagcacattcgccgatgctgggtacctagttaaagaggcatttgtagccctctgctcccatcgtgaacatgctgagagcaatgacaagtcagggctgatttttggaaggtgaacttgcaacttacctcaagtgaatactgttttcagttgtgcaagaagtgctttatgctagtagatatgtgcatgtttcctagagggaatgttttcaagttcagattgattctgctgagaatggacggcaactcggaggcctcaagccaataatgtactacaggccctgacatgttacagctgtgtaaacagggccattctatttcctaaatcacaactaataaagcagaggatgaaaatcaaaaaaaaaaaa

SEQ ID NO: 529 - DNA, 1990 bp, Homo sapiens
ccggcttgaccctgcccgggcgcgccatgttcgcgcgtgggtcccggaggcgccgctccgggcgtgcgcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtatatcaatttttcagctgcctcccagaggacaaggtcccctacgtcaacagtcctggggagaaatacaggatcaagcagctgctgcaccagctgcccccacacgacagtgaggcacagtactgcacagcactggaagaggaggaaaagaaagagctccgagcctttagccagcagcggaagcgggagaatctggggcgtggcatcgtgcgcatcttcccggtgaccatcactggggccatctgtgaggagtgcggaaagcagattggaggtggggacatcgcagtgtttgccagccgtgcaggcctgggtgcctgctggcacccacagtgcttcgtgtgtaccacgtgccaggaactgctggttgacctcatctacttctaccatgttggcaaggtctactgcgggcgtcaccatgccgaatgcctgcgtccacgctgccaagcctgtgacgagatcatcttctcccctgagtgcacggaggctgagggccgccactggcacatggatcacttctgctgctttgagtgtgaagcttcactaggagggcagcgctatgtcatgcgtcagagccgcccccactgctgcgcctgctacgaggcccgccacgcggagtactgtgatggctgtggggagcacatcggcctggaccaaggccagatggcttacgagggccagcactggcatgcctcagaccgctgcttctgctgtagtcgctgtgggcgggccctgctgggccgcccattcctgccacgccgaggcctaatcttctgctctcgagcctgcagccttgggtccgagcccacagctccagggccgagccgccgcagctggagtgccggccctgtcacagccccacttgcagcctccacagcctctttctctgctgtgaagggggcatcagagaccaccaccaaaggcaccagcacagagttagcgccagctacaggccctgaggagccctcccgctttctgagaggggctccccaccgccactccatgccggaactggggctccgcagtgtccccgagccgcccccagagtcccccggccagcctaacctgcgcccagatgatagtgccttcggtcgtcagagcaccccacgcgtcagcttccgcgaccctctggtgtctgaaggaggcccgcgccggaccctgagtgcacccccggcccagcgccgcaggccacgcagtcccccacccagggcccccagccgtcgccgccaccatcatcataatcaccatcaccatcacaaccgccacccaagcagacgtcgccactatcaatgtgacgcgggatcagggtcagactcggaatcttgctccagctcgccctccagttccagttccgaatcatcagaggatgatggcttcttcctaggagagcgcatccctctgcccccgcatttgtgcaggcccatgcctgctcaggacactgcaatggagaccttcaactccccatctttatcgctccccagggactctcgcgcagggatgcctcgtcaggcccgagacaagaactgcatcgtggcttgaaggcaggccgtcctggagggggctccattctccagtcagagtagatgatgaggcccatgcccctcacccccacgccccgcccctacaacctaagtcataaatcctcttcctccctc

SEQ ID NO: 530 - DNA, 7253 bp, Homo sapiens
ggaaagaagtggaataattaggaacctagggtggggtagggtagcaggacatttcaaacattaatgagcatatgagattccaggtcttgttaaaatgcaaattctgattcagctggtaggtgaggtctgagattgtgcatttctaacaagcactcagataatcttaaggctgttggccccagggtcacacttatagtgattttctagaacccagttggggaagtgaatcttgggcaggagaaatacacacctcttgcattgagtttggagatctcatctgatataactttttaagaaagaaaaataattttccaaatatccaattgataagctttcccactaagtggctttcccactaagtggctgcgttatgaaaattgcttcactttgaaacttctggtcttggtaatatagaatttctgtgttctcacagtgcttgattgagaatatgatattgagattatggcataaaatatagtggctgtacaaaaaaaaatacattattaggatctctaacaattatgtaaaagtcattgcttcatgggtagagctcaaactttggtgtgagacctggttttattcttggcacttactctgagttgtcttaggcaaattaataccttaagcaaaaatattctcatgtacattttacatgagaattataaatgaagtacataaagtccagcagtcacaaatgttatctattattaccatcgtcctaagactgcaatcagctatagtgaaagtagtctcaaagattgtttcataaatcatcagattcacctaattttctaaagaatttaaataaggagatggaatgaatagattgcattttgtttccatgcacaggggaactgtgcatatttcttctgtgactcggaaatggtttaacttttaaaaatcccaaaatagctgaagttagcagacatgcaatttaccaaggatgattggaatttttatctttcctgtaataatactatacccaagcacactgctcatgaggaaaacatttttatgtgaatcttttactcttgggggcaaagaatgctgtttttctttttgataactatgtttatagaatctaaatcaccctgagcaattatttcaacatctaaagttattattaccattcatgtttcatttatagctatttgaattttgatgaatttcaatatggtgctacagtgatagggcaagtgcaaataagttcaatatatgggtacggtctaaagctattttaatttttttattacaactgctatgaagaaaattaggatatgccatattttcacgttttacagttggatgtcctatgatgttctcttccagagaacagagctcggagctctggaaatttggaggcaactgatatgtgctcatgtctgcatctgtgtgggttggctgtatctcagggacagagtctgcagcaaaaaagatataattttgaggactgaacaaaattcaggaaggactattctcattaaggcagtaacagagaagaattttgaaacaaaagattttcgagcctctctagaaaatggtgttctgctgtgtgatttgattaataagcttaaacctggcgtcattaagaagatcaatagactgtctacaccaatagcaggattggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacatgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatcaaaaaaaaaaaaaaaaaa

SEQ ID NO: 531 - DNA, 410 bp, Homo sapiens
aaatgagtcacttcttcaagaccctcatgccagtgtttcatctccatttcaggtgccgagccccttttccatgacctggatagcgacgacacctccctcagtaacctgggtgattgtttcctagcaacctcagaagctgggcctctgcagtccagagtgggaaaccccattgaccatctgtactccatgcagaattcttacttcacatcttgagtcttcccctagagttctgtgactaggctcccatatggaacaaccatattctttgaggggtcactggctttaggacagggaggccagggaagaggtgggttggggagggagttttgttggggatgctgttgtataatgatatggtgtagctcagcatttccaaagactgaatacattatggattgcatagtttaatg

SEQ ID NO: 532 - DNA, 5783 bp, Homo sapiens
gcgtcccatggatatagcaacaggtcccgagtcgctggagaggtgcttccctcgcgggcagacggactgcgccaagatgttggacggcatcaagatggaggagcacgccctgcgccccgggcccgccactctgggggtgctgctgggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccgtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtccgagagacactggcagctgagacgggcctcagtgtgcgcgtggtccaggtctggtttcagaaccaaagagcaaagatgaagaagctggcgcggcggcaccagcagcagcaggagcagcagaactcccagcggctgggccaggaggtcctgtccagccgcatggagggcatgatggcttcctacacgccgctggccccaccacagcagcagatcgtggccatggaacagagcccctacggcagcagcgaccccttccagcagggcctcacgccgccccaaatgccagggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctgagagccagccaggcgcacggacgcttgggcaggggcctgggggggactgccagcctctgcggccagcctggccacccccgccctgctctccgcacagactacagacagccatacggtgccctcccctcggccagctgggcctgaccactgtgcccgttgggtacagccagaccggtagatgggcacagcctgggcaggggctgtgtcctgcccacagagaccttgtcatccccagggacccagagctctcggacggccactcgcctcccagccccacctcggcctccatcgcctcctccccatctcttttttgggaagcttaaattctctctatttttttaaatgtcctctctgtgtccatggccctccatgcaagccccaggacaatggtgtcatgaggcggtgacctgagaagcgtgtgtacctgtgccccagcaagggcaggggtggcctctgggggcaggcccactgcctggaaccgcacacccctcagcctgagtctggagcagcagtggagaggggcctgaggggaggcactgtcaggaggcgggctcggagcctgagcctgggcaggcgcaaagggacagagaggcacgtgcagacacatgcacacttgcagacaaacccacgcaaacacacacacagctgtatggggacaccagaagggacagggatgctcagcgggtctgtcctgccttgtcagaaagagaaaaggaggccaggcaggggaccccccagttcttaagagcgattggaaagggaggaaggggagaggaagaggcgaacttgaagcatcggacccagttgtatcccagcctgggcccaaatgggggcagcctgggcagggagggcagccccaggccccaccaactctagaggcagatggagcccccagaaccaggtagcatcagaccagacaacagagcctccaggggtcagggacttcagaagcacctgctgggcaccccatctgcaatgtggtcctctccccagccacctctgcctcccctcacatacctccagtgacaaggagctcactaggtcagcgagcccacagcagctgtgctgtcctgcatcccagagccaggcttccccagctctccctcttaacactgtcccccagcaggcctccggctgtccctctaaaggtgtggggcaggtatcacttcaccttcccactgatgtcagccggccagaagtgagcaggcacatcacctctcctgctgtggcacccttcctctgttaatttggcccaaaagacaatgatttggccacatgaccttagagattcaccctgccctgctgtagctaaatccctgggccccacacgcaagtgacagctaagccacatctgttttctgtgtatatgcaggatgggggcacctactgttttgttttgttttgttttgttttgttttgttttgttttgttttgttttgtttgagacggagtttcgctcttgttgcccaggctggagtgcaatggcgcgatctcggctcaccacaacctccgcctcccaggttcaagtgattctgatgcctcagcctccctagtagctgagattacaggcatgcgccaccacacccagctaattttgtatttttagtagcaacggggtttctccatgttggtcaggctggtctccaacccccgacctcaggtgatccgcctgcctcggcctcccaaagtgctgggattacaggcgtgagccaccgcacccagtctgcacttactgtttagactgaatgagggaccgtgacctctttccttttccattccttcttactcgattcattccagcctgtggaatttctctgcaccctgattcagtgaccactgctctcctctctcccagcacatctgcccagtgaggagttggccctgggtctcacctgaggtgtgtggaccgggctggcctctccctgtttgacattggcccattaatgcatcctctttgggggacacattccaattgcatttcctgcccccttctcccagggcaattgcagaagattgtgtcaggcgccctgctggaagtcaggtgcactagatccatccccagccccagtctgctcaactctatccctgtcagagcaaggaggctgggctgctggggcctgactggtgagcccaccctgtcccctggtgatcactgtgtccccttgttcaggtgctcacaaccctacctttaactctgaggtcaagccctaggccaccaccctaaagtctgcctggtccaacctttgagcaagtaaggataatgaatgtcccttttccacctttggggccctctgcctggatctctggaatcctctaagttcaacctgttctgtggttttgctcccgtttgctgggaaattcagtccccccagaatgtcctgggccaacctccttgcctgacatgtggcctcgtgtcacccattgggccccagcagccagctagcccttctgcagctcttcttacaaacagagcctctccaaggacctcagttgatgttctggtccttctgccgcctcagcccaccagggtccgtgccaccatgggtctcttgagcagcagctgcactggcttctggagagacacccctctttctccttttgcacatgcaccatctgaatcgtgccagggacatcctgggcagattcaggggcagatgccctatcccccaggagacctggcccttctctctcagacccaataagttggaagggacgtcagaagcggtcatctcatctgccccttattttatagttggaaaccctgaggcaagagagggaaagaggcctgtccaaggtccgggttagtgacagagctgagctgagaacagggacgttgtgccccactgtcccctgtggtttgtgaatgacctccaggtcagggggtcacaacttgttcttagtaaacttgccagctgttggggtcacatattcccattctggggcctcacaaacccccgaatccagccgggaccccatgccaggagctggtctagggacagcatgcttgtgacccacagactgttaaagccagaagggacctcagagagtcccttatgctggaggcgccctgtcagccgtggctaggggccccttgctctatgctgtgccttgctgcccacaggctcccagacaccagtgcccactctgcccagccccggactgggtgtggctcgcagatgaacaagatgcagggcctgccttgaggggtgtctcctagaaggaaagccagactctccggcccagccagagagtccagacatggcagggacccgtttctcagatgaggagcctgaggctcagagaagggaggcgatgtgttcagggccacccagcagaagcctgtggggctgggcaaccttctcccactttatgggaggagctgcagccttggctgggagctgggcggggagtagccaggaccaccccttgcccgtgccgtgacatggaaccttcatcactaagggggctggagtgggaagagggagataactgtgtggtctccagagcaaaagagaatgagaggtgggcagggggagtcttggcaaaagaccaagttccacttccctgctggggaagtcaaggctcagaaagaggaaataattgccccaggtaacacagggcagaggagggacaaaaagctgggcatggccccagccagagcctcatctgcctactccgtgaagcctcccaggtactctgctatcctgggaaacgcacagggaggccacacagagacactgctcacaagagtcagaccaaggtgccagcacagcctggaaagagctcagaaagggggttggtgcacgtggctgggcatcttaggaggcttcctgagggtgggtaaaggtgggaaggccctggcgctgcatcagatgagcagggcctggcagggacaagcctcttctcctttgggaagccctgcagcctcctagcaagaggctgattccccactctgcccccatctgaatgtccttttcatgttgcacgcagggaacctcaggaaggaggattgcctgatgcctgcctggctccatccttgagctctgggcaccacctagggtgagggagagcctgcagctctggggctaagtctgccctggggggaaagggctccacgctcacacgcacgcgctcgcacacacacactcacacctggacgcacacggaggcttgcggacccatactcacaggcacatgtggcctggggactgggggagcaggaaagacccctccaacatttggcccttggaaggcaccattgccaatgagcctctttgctggttcccccgaccccacctgggggtcccatgggagcccagcccagccaggtgtggggatgggccaccggccattcctgttttccttgtacagacagattctcactacccacccgccatccccagacacattttatttaataacttgtcattgttaaattatttattagcgtttaccacaccaccacccccaccctgccctccactctcaccttccacctcttcccacaacagcagaaaatggaaacaacaacaaaaaaagatgagacatcagtatatttgtaaataaaccgacctgtacactcaaaaaaa

SEQ ID NO: 533 - DNA, 1468 bp, Homo sapiens
cgagagcacgtgtccagaccctagcctgtacgacgctgactctgcccggtcccagaaccaaagccatgccggggtgtggcctctgaccccacgcggaggggacctcgccttgcgggaccccacctggaacccgacctcccagcctcgcagccggcctgagccgccatgcgcgggaagttgctgccgctggccggcctctacctggtgcagggcctgccctacgggctccagtccggcctcctgccagtgctgctgcgtgccggcggcctctcgctgacgcgcgtggggctggccaaggttctgtacgctccgtggctgctcaagctggcttgggccccgctggtggacgcgcagggctcggcgagggcctgggtgacgcgcagcacggcgggcctgggcctggtgtgtgggctgcttgccgggctgccccctcctggagctggccaggccgggctgcccgccgctgtggcggggttgctgctgttgttgaacctgggtgccgccatgcaggatgtggccctggacgcgctggctgtgcagctgctggagccggccgaactggggccgggcaataccgtgcaggtggtcgcgtacaagctgggggccgcgctagctgggggcgcgctgctggcgctgctgcccaccttctcgtggccgcaactctttctgctcctggctgccacctactggctggccgcggccctggcctgggctgcaccagccctgcggcggctcccacagcagcccccttccgagcagcgtccccacaccgcgcaccttctgcgggacgtgctagccgtgccggggaccgtgtggacggcaggctttgtgctcacctacaagctgggtgagcagggtgccagcagcctgtttcctcttctcctgctggaccacggcgtttctgctcccgagttgggactgtggaatggtgtgggtgctgtggtctgctccatcgctggctcctccctgggtgggaccttgctggccaagcactggaaactgctgcctctgttgaggtcggtgctgcgcttccgcctcgggggcctagcctgtcagactgccttggtcttccacctggacaccctgggggccagcatggacgctggcacaatcttgagagggtcagccttgctgagcctatgtctgcagcacttcttgggaggcctggtcaccacagtcaccttcactgggatgatgcgctgcagccagctggcccccagggccctgcaggccacacactacagccttctggccacgctggagctgctggggaagctgctgctgggcactctggccggaggcctggctgatgggttggggccacatccctgcttcttgctcctgctcatcctctctgcctttcccgttctgtacctggacctagcacccagcacctttctttgagctgagtggctggagtggtcaataaagccacatgtgcctgtgaaaaaaaaaaaaaaaaaaaaaa

SEQ ID NO: 534 - DNA, 1765 bp, Homo sapiens
gatgtggctgggccattgtttctctctgctgccggagctccaggtctacccttcactgctctgtgtcctcagcgtgtgtggcttcgtgacctgaagatactgggaaatccatagctaagatgccaggaccccctgaaagcctagacatggggccgttgacatttagggatgtggccatagaattctctctggaggagtggcaatgcctggacactgctcagcaggatttgtataggaaagtgatgttagagaactacagaaacctggtcttcttggcaggtattgctgtctctaagccagatctggtcacctgtctggagcaaggaaaagatccctggaatatgaagggacacagtacggtagtcaaacccccagtagagacggggtttcaccgttttagccaggatggtctctatctcctgacctcgtgatccgcccgcctcagtctcccaaagtgctggtattacaggcgtgagccaccatgcccagcctaataaaaatttttttatttctattgtatccaatagcttgttttaagtgtgtagaacaataacttacacttttatgttaattttatattttgttaatttactgactgtattattagtttagacaaatttcaatgtactgtggttttttatgtgtaagattatatgttcctcaaacagcaactttttacttatttgtcttcagtttcaatggctttaaaaagaattcttttttcattattctgccacatgcttccagtgctatgttaaaatagaaacattgacaaagggcacaatagagtttactattggtgtctgtgaatttgaaatggcaaacaactccttaagtttttataagctgatttcaggaggtaaagatcttcttttcttgtgttccccagggttttgggatgccctctgggtttgtagtggagtggggttgtaacttggttgcaaggctgctggttctacattagggtccatatttagttgtcatgttacaagaggcttgggtagttgtacttcccaatttttttttttttttttttttttttttttgagacaggagtctcgctctgtcgcctggctggagtgcagtggtgtgatctcagctcatcaaaacttttgcctccctagttcaagcgattctcctacctcagcctcctgagtagctgggattacaggtgcccaccagcacgcccagctaattttttgtgtgtttttagtggagacggggtttcaccatgttggctaagctgggtctcgaactcctgacctcaggtgatccacccgccttggcctcctgggtgctgggattacagacgtgagccaccacccccggccacttgtttcttttaaatgcttattaaaagtttctcatcagaatattttatttataattatactgcatattctctgaaattttactgccaatttttcaaaatacctgcttttgatgagtacagttacagtcaaatactgtagttagacaaattcttttttaatggtatattaatgttgcataccaaattgtatgagttaaacgtctcttcctgtgcagtttcatattagtggtgttttcagtgtaggtatcttaatatcagcttatcgtggtttttggttatgtattataattttagtcaatttgcaattctgtctgtatactttatgtcaatgtgaggttgaattaaaagatagccatatgtctatcacaaaaaaaaaaaaaaaaaaaaaaaaaaaaaaaaaaaaaaaaaaaaaaaaaaaaaaaaaaaaaaaaa

SEQ ID NO: 535 - DNA, 2724 bp, Homo sapiens
ggaagccggcatggcgctccggtcaataaaatcgatagctggaagctgcctgtgttccaggcaaaggcggtgcggtagcagcgccgccattttccccgaaggcatcttccggtgcctttcacccaagttcgggcaggagtttcctgaataacagcaaaaggtttccgttagccccgcgggcgaccaattccgattccctccgggcctccccggccacgctcagccctggtccggcaggggctcctcgatcccaggggccgccagcgcccgagggccgaggcctggacacggaaggccgtggcgccggcttctcgggtcccatggcgccaccttcggctccgctccctgcgcagggaccaggaaaggccagacccagtcggaaaaggggcaggaggccgagggctctgaagttcgtggacgtggccgtgtacttctccccggaggagtggggctgcctgcggcccgcgcagagggccctgtaccgggacgtgatgcgggagacctacggtcacctgggcgcgctcgggtgcgcaggtcccaaaccagccctcatctcctggttggaacgaaacaccgatgactgggaaccggctgctctagatccgcaggagtacccgagagggctaacagtccagagaaaaagcagaaccagaaagaagaatggggagaaggaagtattcccgcctaaggaggcaccccgaaaggggaagcgaggccggaggcccagcaaaccccgactgattcctaggcagacgtccgggggccccatctgccctgactgcggctgtaccttccctgatcatcaggccctggagagccacaagtgcgcccagaatctaaaaaagccttacccttgcccagactgtgggcgccgcttttcctatccatccctgctggtcagtcaccggcgggcacactccggcgagtgcccctatgtttgtgaccagtgtggcaaacgtttctcccagcgcaagaacctctcccagcaccaggtcatccatacaggggagaagccctatcactgccctgactgtggtcgctgcttccggaggagccggtccttggccaatcaccggaccacacacacaggtgaaaaaccccaccagtgccctagctgtggacgtcgcttcgcctacccctccctgctagccatccaccagcgtacacacacgggagagaagccctacacttgcctcgagtgcaaccgccgcttccgccagcgcacggccctcgtcatccaccagcgcatccacacgggcgagaagccctacccgtgcccggactgcgagcggcgcttctcctcctcctctcgcctggtcagtcaccggcgtgtgcactctggggagcgtccctatgcctgcgagcactgtgaggcccgcttctcccagcgcagcacgctgctccagcaccagctcttgcacaccggagagaagccctacccctgcccagactgtgggcgtgccttccggcggagcggctccctggccatccatcgcagcacgcacacagaggagaagctgcacgcctgcgacgactgtggtcgccgctttgcctacccctcactgctggccagccaccggcgcgtgcactcgggcgagcggccctatgcctgcgacctttgctccaagcgttttgctcagtggagccacctggcccagcaccagctgctgcacacgggggagaagcctttcccctgcctcgagtgtggccggtgcttccgccagaggtggtctctggctgtccacaagtgtagccccaaggccccaaactgtagccctagatctgctatcgggggctccagtcagaggggcaacgcccattagaaggggaaggactgcctacgttcatttcattttatggagggtcccagaaaagggaaggaggagccccaggtcatacagggcagagtcagaactaaacccgggtctcctgctgcacagagctgaactttgtatcttgcaatgcgctggctgcctccctgtgcgtgtctggaacagtcccattaggagaggtgacgtcatttgcttaaagttttccaagctaccctatcctaaaatagtttgtgtggatatcagggctaaaagttctccccatctattttaggggctgtctgcttttctagtctgtccacacagggattacctgtcatcttgcatgcaatcaggagaatctcataggggcaggaccttcccctactctgcctcttcctccatactaggttggaaaaatctggtttagcccactttttgcaacactcctgccaagtggtcttctacccattgcttgaaaatctctcttgacagggagctcactacctcacaaggcaggtcatttcattgtgggatctatagaaggttaagtaccacattctcctctaaaccttgcctacgacatgtttaatacttcatctacatagcagcccttcagataatcacaaccactttgcccccaagttttcaggttaagtagcatgaatttggtcattccttaaagacagggtttcaatttccacacatgatctctgcaaacaggcactgggttttcagtgtcctttttgaagggtcatataaaaataaggtaacaccacagtgccactacaccttctggggctggacttgtttcagcagctttggttgcactgaatttgggggagctgcatggtaccaggggtttattgggttgcagatatataaatgccctaaacttaaaaaaaaaaaaaaaaaa

SEQ ID NO: 536 - DNA, 2255 bp, Homo sapiens
agtttccattcttggtctccttttggcgccctggggcagcgagagaccgtgagaaatttctcggcggcgccgaagatgcgcgccacttccggtctggctcctaacaacgggggaggctggtaaccagggtgggggggatggcggagcgggcgctagagcccgaggcggaggcggaggctgaggcgggcgcgggcggggaggcagcagccgaggagggcgcagcgggccgaaaggcgcggggccggccgcgactcacggagtcggaccgggcccggcgacggctcgagtcccggaagaagtacgacgtgcggcgcgtgtacctgggcgaggcgcacgggccctgggtggacctgcggcgccgcagcggctggagcgacgccaagctcgccgcctacctcatctctctggagcgcggccagcggagcggccgccacgggaagccttgggagcaggtccccaaaaagccaaagcggaagaaaaggcggcgacgcaacgtgaactgcctgaagaacgtggtgatctggtacgaggaccacaagcaccgctgcccgtacgagccgcacctggcggagctagaccccacttttggcctgtacaccacggccgtgtggcagtgcgaagctggccaccgctacttccaggacctgcattcgcccctgaagcccctcagcgactcagaccctgacagtgacaaagtgggcaatgggctggtggctggcagctctgactcatccagctctggctctgcctctgactctgaggagtctcctgagggccagccggtcaaggctgcggcagcggcagcggcagcgacgcccaccagcccggtgggcagcagcgggctcatcactcaggagggcgtgcacattccctttgacgtccaccacgtggaaagcctggccgagcagggtaccccgctgtgctccaacccagcaggcaatgggcctgaagccctggagacagtggtgtgcgtgccggtgcctgtgcaagtgggtgcgggccccagcgccctctttgagaacgtgccccaggaggccctgggtgaggtggtggccagctgccccatgccaggcatggtgcccggctcacaggtgatcatcattgcgggccctggttacgacgctctcacggccgagggcattcacctcaacatggcagcaggcagcggtgtccccggcagtggactgggcgaggaggtgccctgtgccatgatggagggtgtggcagcctacacccagacagagcccgagggtagccagcctagcaccatggacgccaccgcagtagcaggcatcgagaccaagaaagagaaggaggacctgtgcttgctaaagaaggaggagaaggaggagccagtagccccggagctggcaacaacggtgcctgagagcgcagagcctgaggcagaggcggacggggaggagctggacggcagcgacatgtcagccatcatctatgaaatccccaaggagcctgagaagaggcggcggagcaagcggtcgcgggtgatggatgctgacggcctgctcgagatgttccactgcccatacgagggctgcagccaagtctacgtggccctcagcagcttccagaaccacgtcaatcttgtgcatcggaaaggaaagaccaaagtgtgccctcatcctggctgtggcaagaagttctatttatccaaccacctgcggcggcacatgatcatccattcaggtgtccgtgaattcacctgcgagacctgcggcaagtccttcaagaggaagaaccacctggaggtacatcggcgcacccacaccggcgagacccccctgcagtgcgagatctgtggctaccagtgccggcagcgcgcgtcgctcaactggcacatgaagaagcacactgcggaggtgcagtacaacttcacgtgcgatcgctgcgggaagcgcttcgagaagctggacagcgtcaagttccacacgctcaaaagccacccggatcacaagcccacctgacccacctgaccactgaccgcccctatttattcgtccgctcggacaccacgcccgggcttgccggggcctggacagctgcgagggccgcccggaccgcgggccggaaggaggcgcccccgccccgccccagagctgggccccctgggcaggttccccaccccgccccaccgcatccttctcggagctggtgcctggggctgcattgctggaactgtgtcaagagagcagagtgagattaaagagcgagaaaggagaaaaaaaaaaaaaaaa

SEQ ID NO: 537 - DNA, 2016 bp, Homo sapiens
tccgaggccccgagggcgggacgtttcgtcctccctgccgcgcgtgccctgcctaccacgagcggcccgggagtacctgtacctttcagctgcgccggccgcgaggccacggagagctcgccttggagagcccaggagcaggggagacatggactcagtggtctttgaggatgtggctgtggacttcaccctggaggagtgggctttgctggattctgctcagagggacctctacagagatgtgatgctggagaccttccggaacctggcctcagtagatgatgggactcaatttaaagccaatgggtcagtttctctgcaggatatgtacgggcaagaaaaatctaaggaacagacaataccaaacttcacaggaaataattcctgtgcctacactttagaaaaaaattgtgaaggctatggcactgaagaccaccacaaaaatctgagaaatcatatggtggacagattctgtacacataatgaaggtaatcaatatggagaagccatccatcaaatgccagatcttaccctgcacaagaaagtttctgctggagaaaaaccatatgaatgcaccaagtgcaggacagtcttcacgcatctttcttctcttaaaaggcacgtcaagtctcactgtggacgaaaagcacctccaggtgaggaatgtaagcaggcctgcatttgtccctcacacctacacagtcacggaagaactgacactgaggagaagccgtataagtgtcaagcatgtgggcaaactttccaacatcctcgttacctctcccaccacgtaaagactcacacagcagagaaaacctacaaatgcgagcagtgtcggatggcgtttaatgggttcgcaagcttcactagacatgtgagaactcacacaaaagacaggccatataaatgtcaggaatgtgggagagccttcatttatccctcgacatttcaaagacacatgacaacacacactggagagaagccctataaatgtcagcactgtgggaaagccttcacttacccccaggcttttcaaagacatgagaagacgcacacgggagagaagccctatgaatgcaagcagtgtgggaaaacattcagttggtctgaaaccttgcgagtccacatgaggatccacactggggacaaactctataaatgtgaacactgtgggaaggcttttacctcttccagatcattccaaggtcatttgaggacgcacactggagagaaaccttatgagtgtaaacaatgtgggaaagccttcacttggtcctcaacgtttagagaacatgtgagaattcacacgcaagagcagctctataaatgtgaacaatgtgggaaggcttttacctcttccagatcattccgaggtcatttgaggacgcacactggagagaagccttatgagtgtaaacaatgtggaaaaaccttcacttggtcctcaacgtttagagaacatgtgagaattcacacgcaagagcagctccataaatgtgaacactgtgggaaggcctttacctcttccagagcattccaaggtcatttgaggatgcacactggagagaagccttatgagtgtaaacaatgtggaaaaaccttcacttggtcctcaaccttacataatcatgtgaggatgcacactggagagaaacctcacaaatgtaaacaatgtgggatgtccttcaagtggcactcctccttccggaaccatctgaggatgcacacaggacagaaatcccacgaatgtcagtcatactcaaaagccttcagttgccaagtcattctttctaaaaccagtgagagcacacactaaagagaaattctataactttaatggggtaacctcacattaattcatgtataatgctccagaaaattcacaccaggagagaaatcttacaagtatgatattgtctttgtcaatacctcatttgtaaaacagacccattagtcgtgaatttccagctctttcaaaaataaatgtttatgtgagaaaataaaaaaaaaaaaaaa

SEQ ID NO: 538 - DNA, 1839 bp, Homo sapiens
ttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggtaagtgaagcttcgggcccttacatctttcttgaaggcaagaagcctctcctctacttcccagacaccccgcctcccccactagaaaaagcagccgaagcggctttatttaagggcaagtgggacgatgaggccagagaagtcagaaaggctccatatttgatatggtcaaataatggcgcccttaagagcagcctgtgacaattgaagggtggtcgccatattttcagaaggcaccttccgggtcccttaacccgggtgtctatgtccaagcggccatgaagtgaataaacactgaggaattatatttgtccctatcagaatcctcgaatccctagcagccagtccctgctacttcggttgcctcggctgcgttcggacgccacggctgggcggggccgcccttcctgtggacaacgacagctgaggccgggagcggggaggcggcggctccagggacctggcggccgccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaaaaaaaaaaaaaa

SEQ ID NO: 539 - DNA, 6513 bp, Homo sapiens
gtctctcccttcagcccgagctccgggtctcgtcttcactgctctgtgtcctcttcttctagaggcccagcctctatggccctctgacctgcaggtattggcgatccatagctaagacgccaggtcccccggaaacctagaaatggaaccattgaaatttagggatgtggccatagaattctctctggaggagtggcaatgcctggacactatacagcagaatttatataggaatgtgatgttagagaactacagaaacctggtcttcttgggtattgttgtctctaagccagacctgatcacctgtctggaacaagaaaaagagccttggactagaaagagacataggatggtggccgaacccccagttatttgttctcattttgcccaagacttttcaccagagcagaacataaaagattctttccaaaaagtgacaccaagaagatatggaaaatgtgaacatgagaatttacagttaagtaaaagtgtggatgagtgcaaagtgcaaaaaggaggttataatggacttaaccaatgtttgccaactacccagagcaaaatatttcaatgtgataaatatatgaaaatctttcataaattttcaaatttaaatggacataaggtaagacacaccagaaaaaaaccttttaaatataaagaatttggcaaatcattttgcatattttcaaacctaactcaacataaaataatttgtactagagtaaatttctacaaatgtgaagactgtggaaaagcctttaatggatcctcaatctttactaaacataaaagaattcatattggagagaaatcgtacatatgtgaagaatgtggcaaagcctgtaaccagttcacaaaccttactacacataagataatttatactagagacaaactctacaaacgtgaagaatgtagcaaagcctttaacctgtcgtcacacattacaacacatacaataattcatactggagagaatccctacaaacgtgaagaatgtgacaaagcctttaatcagtccttaacccttactacacataagataattcataccagagagaaactcaatgaatataaggaatgtggcaaagctttcaaccagtcctcacaccttaccagacataagataattcatactggagagaaaccctacaaatgtgaagaatgtggcaaagcctttaaccagtcctcacaccttaccagacataagataattcatactggagagaagccctacagatgtgaagaatgtggcaaagcctttaggcagtcctcacaccttactacacataagataattcatactggagagaaaccctacaaatgtgaagaatgtggcaaagcttttaacaagtcctcacaccttactagacataagagcattcatactggagaaaaaccctaccagtgtgaaaaatgtggcaaagcttctaaccaatcctcaaaccttactgaacataagaatattcatactgaagagaaaccatacaaatgtgaagaatgtgggaaagcctttaaccagttctcaaaccttactacacataaaagaattcatactggagagaaaccctacaaatgtgaagaatgtggcaaagcttttaaccagtcctcaatccttactacacataagagaattcatactggagagaaatcctacaaatgtgaagaatgtggcaaagctttctatcgatcctcaaaacttactgaacataagaaaattcatactggagagaaaccctacacatgtgaagaatgtggcaaagcctttaaccattcctcacatcttgctacacataaggtaattcatactggagagaaaccctaccaatgtgaagaatgtggtaaagcctttaaccagtcctcacaccttactagacataagagaattcatactggagagaaaccctaccaatgtgaaaaatgtggcaaagcttttaaccagtcctcaaaccttactggacataagaaaattcatactggtgagaaactctacaaacctaaaagatgtaacagtgattttgaaaacacttcaaagttttctaaacataaaagaaattatgctggtgagaaatcttagaaatgtgaagaatgtaacaaaacctttaaaagttgtcacacttgattgtgcataagataattcatactaaaaaaaaacctacaagtgtgaagaatgtggcaaaacttttaaccaatgctcacaccttattgcacaggaaagcatttgtactagaaaaaaatttcaaatatacagaatgtgaaaaagccattaatatctgttcacatcttactcaacatcagagatttcatacttaataaaagcattatacatgcaattactgtcaaaaatctttcagaaaatataagcctctaaagtgaagagtattcattttgaagacacacattatgaacataaggagggttgtggtacctttacttgtatcacagatctcattgtacacattttgtgctagaggaaaaccatggagcagttgcttaaactttgtgcaacataaggaaatttatattggagaaaaaccctgcaaatgtaataaatttgggaaaacattttttcaaaaacgacagcttagaaaacactagagggttcatactaaaatctatttttgcagatgcagtaaatatgaaaaaatatttaatccaaaattctatgtaaatatcagataattcacagtagaaatagttaaggcactgacacttcaggcattacactaaatcagattgctgagtatagaaaagaatctaaaactaaagttggtaaatgaattatttgtatataacattataagaagtagaaaatttttgcagagttgtaactacattcaaactatcctttgaaaaaaattaggttttatgaaaagtgaataatgtcatttaactcaagttatgctcttcattcctattgtattcacatgtgaaagcatgtgacttaattgttgctgcatcaaagatgagagattctttgttattaggtgtgcattatttacgaccttttttagtgaaagagttaaggacattaaaatgtaagatgcaagatgaaaatgtaagtggagaggctctttctggttaatttataatattgactgatgcatgaggtaggagttcagataaatatcctgtgttatattgagaaaaaaaattttctggtatatcattttactaattgtactttttttttttttgagacagagttttgctcttgttgcccaggctggagtgcaatggtgtgatcttggctcaccaaaacctccacctcccaggttcaagggattctcctgcctcagcctcccgagtagctgggattacaggcatgtgccaccatgcccggctaattttgtatttttaatagagatggggtttctctatgttggtcaggctggtctcaaactcccgacctcgggtgatccacccacctcggcctcccaaagtgctgggattacaggcgcgagtcaccatgcctggccaattgtacttttatgtaataaaatgtagtacattttaaaatttttagataatgtgtgaacttattaatcaggctttttaaaaaacatgttaagaccatcgtgcattcaatgaagcattattatgccattaaatttaacttatcccatcttactcaagggtataggtaaatgatggtaactatacactatttaataagataatggactaacatttctagtaatctgttttgccagtggctttaaattgcaaataagtcagagaatattattcctgtaggttgaattattactcattttttcttatttaaacttatttttcttaatttttgtgggtacatagtatgtgtaaatatggcatatatggcatattttgatacaggtatataatatgtaataattacatatgggtaaatgaaatattcattacctgcagcatttattgtttgtatttgtttgtattataaactaattctgcacttttcggtttttttttgagacgagtctcactatgtcacccaggctgtgcacgcctgggtgcattggcgtggtctcagctcactgcaacctccgcctactgggttcaagtgattcttccgcctcagcctcctgagtagttgggactacaggcgcatgccaccacactcagctaatttttgtatttttagtagaaacagtttcactacgttggccaggtttgtcttgaactcctgaccccatgattagccccctcggcctcccaaagtgctgggattacaggtgggagccaccacacccagccacttttagttgttttcaaatgtacattaaattgttgttggctacagggtctcttttatggtcataagaaaacaatataaacaaaatgcatacatttctgagacctgaattaacattaaaaaattgttatatatttttcttcaaacatgttgcctctctgcctgcaagcacatacagactattagttttgatttacacagagttaaatatatacatatattactttaaagataaagcttgggtttaaaaaaattatggagtaaataaatgccttctttgcgagtatgagtttctacctagtttcagaagagcaatattgaaacaaatcaaattattttaattagatgatgactgcaaaactaaaaaaacttaaaaatgctgaaaacaaatccatactctctgctttgtattgaattgattactgtaaaattgtatggcttataattcagaatctccctatgcaaatttttgtttttacttgcctgattcttaggctagacccataattttcttgtgtcttacatttttttctcttattttatataagatgctatgtgagctggtcagagattataaaaataatttttataaaattagtgcaaaaaatttagatttaatttcaaaattagtgtattgttatattttatgttgttagaatattttattttgttcttttaattggagaacgctgtataagcctactttttttagtttttgttcctttcagtttttataatgaaaataagtaaatattgattgagcccatttatttaggtgagtactaggggggcttcctaaatcatgaggatgtttttatatataaatatagcaaacaaacatgacagtgctttctgtgtcacagatgctttataataagccataaatattcctgttggagttagtttgtaacttcaagacagagatggaacatatcaattgtgagaaataacattgattttttatgtggagaggacatttattttcaggctgcaaagctcagttttgctgaattaaaaaattgtgcttcttttatttcctaattgtcttagttttgtttgtcttattatgtgtatttcagctgtgtatgcatcacagccctcctttttgctgtgctgtggctacagttttctcactgttctcttcacaccatgtcatttcacatggtatattgtaggttttgatgagaaatcggtatttttaatgcactgcaagattggttttaactggagattttgcatatcaatataattttctgatcagttaaattaaaacaaaaagcatacagtgtccacagatgaaaggattaaatcatttagcgttgtttttctctgtttgttaaagaataatcttattaaattcttacacaaagtgtggcaaatataaaatttgcttgaaaatatatcttagaaattaaacttttaatttaattttctacagtatacttatgccacaatgtacgtttccatgcaaaatcttctatttgtaagtgtgaacattaaacattgcaaaatagtaaaatgacctctgtgattttgaaacctggagtaatatttcttttccatattcatattacaatttgaagaaattttctcagttttatatgtttttttagtgggtgaagttcagtctacagtttttacatttagtcacctaactctagccaacttcttggtcatattctctggaaaacattcgaagatcatggcagcttttagataaaaacattttctattattttgcgtgcaaacttgtttactgtgttcacagagtggccagtcatgagaccataagaaacagctgcccttttagtgtctttcataccgtctgtaatatataaattgtgcatttattctgtgaagcatgacattttgaagtatatacacattgtcaaatgcttcattctaggtaattaatgctttacctaacatagttaacatttttgtggtaagagcacatgacaatgttttagcatttttcagaaatacaaatacattgttatgaactataggcaccatgcagtacaaaagcttttttgaacttatttctcctattcaactgtaattatgtatttgactgacatctttctaaacccctcttttttccaaatatgttggcatctggtggtcaccattttattctccacttcagttagattaatttttctagaatcatgtaagtgaaataatttggttaatctatgtaattgaaaataataaatttttttattttaaagatgaaaaaaaaaaaaaaaaaa

SEQ ID NO: 540 - DNA, 1835 bp, Homo sapiens
atccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtgaaaaaaaaaaaaaaaaaaa

SEQ ID NO: 541 - DNA, 2621 bp, Homo sapiens
gcgcccagccgctgaacggcgtgggcaggtgggcggtggggttccagggcgccccgaggacagggggccccgacttcaggggaaccccaaccctgaggggcgtacatagtaatcacgccccagccgcaccggaccttgcgctcatcccttgcgtcccccacttctgcacaaacttttctgacgccctggctcgtgggggtcgtggagagcgctggggctaccaggtgggctcccaccccgccggaccctagccacgctgacctcctgcctctcctaacctcagtggcgacctctccaggccgggccgggctcggcactcggagcgagtgcggcaaccactgtcgctctccgaaggctcctgcgccccccggggcagctgggcggggtaatgccctcagtgatggagaagccgagcgcgggctctgggatcctgtcccgtagccgggccaagacggtgcccaacggcggacagccccactcggaggatgacagcagcgaggaggagcactcgcacgacagcatgatccgcgttggaaccaattaccaggccgtaattccggagtgcaagcctgagagccccgcacgctacagcaacaaggagctgaaggggatgctggtgtggtcacccaaccactgtgtgtcagatgccaagcttgacaagtacattgcgatggccaaggagaagcatggctacaacattgagcaggcgctgggcatgcttctgtggcataagcacgatgtggagaagtcgctggccgacctggccaacttcaccccattccctgacgagtggacagtagaggacaaggtgctgtttgaacaggcctttggcttccatggcaaatgcttccagcggatccagcagatgctgcctgacaagttgattcccagcctggtgaaatactactactcttggaagaagacccgcagccgaactagtgtgatggacagacaggcccggcggctggggggccgcaaggacaaagaagacagtgatgagctcgaagagggtcgaggaggcgtgagtgagggagagcccgatcctgcagatcccaagagagagcctctaccctctcggcccctgaatgcacgcccaggccctgggaaaaaggaggtccaggtgtctcagtaccgccaccatcccttgcgaacccggcgtcgcccacccaagggcatgtacctgagccctgaaggcctcacggcagtgtcaggaagcccggaccttgccaacctcacgctccgaggtcttgactctcagctcatctccctcaagcgccaggtacagagcatgaagcagacgaacagcagcctgcgccaagccctggagggcggtattgatccactacgccccccggaggccaacaccaagttcaactcccgctggaccacagatgagcagcttttggctgttcaagccatccgtaggtatggcaaagactttggggctattgcagaggtgattgggaacaagactctgacccaggtgaagactttctttgtgagctaccggcgccgcttcaatctggaggaggtgctgcaggaatgggaggctgagcaggatggggcccctggagccccagtccccatggaggaggctaggagaggggctccattgccagccccagccctagaggaagatgatgaggtccagattacatcggtctccacgtccgtgccccgatcagtgccccctgcgccaccaccccctccacctcccacctcgctgtcccagccacccccgctgctgaggccacctttgcccacggctcccactctgctccgacagccacccccactgcagcagggccgcttcctccagccccggctggcccccaaccagcccccaccgcctctcatccgccccgctctggctgccccccgccacagcgcccgccctggccctcagcccccacccaccctgattggaacccctctggagcccccagcaccctcactctgagccctgacgtcctccaccaaccacgggctccaggacccctttgctggccatccccaggcatctctggtgtcactgaggacagaagggactagggctctggcggggtctttgtaagaccagagtttcggacagcccagccccgccctttgggttctgcatgtgttcctggcagctgggcctgtctcctggggccatggccgggctcaggggcctttgagctggcctgagggcactttcgcttcctggccggtactggaatggctgtgtcctagtctgctggggcttggcctctgggtcctgccctttgtgtgtccggggtagtgaccttagcgtggagtggggagagggcagttgggtgtgctggctgttctcattcctctttcccttcttttagcaataagtctggggtgaggtggggagggaggctgcagggggggaggtgggcagaggggccttacagcagcagaggctggaagagaagctctgtcttcaggggccagctgggaaatgctaaggagctgagggtgcccaccaagcccaccttccagaaacttggagaaatgggggttgggaacttatgcagacatggatttatttttcaacattttttaaaaattaaaaaaaataaaatctaagcttactgaaaaaaaaaaaaaaaaaa

SEQ ID NO: 542 - DNA, 1717 bp, Homo sapiens
agcttcgcgcttgctcacgaacttgcctgcctggctggcgcacccagcccctccttccattccttcttccccctctctgcagcctctgccagcccgcactgcgcatgctttctgacgccccctttggtccagcgtgggaggaggggatggaaatgaggttgggctaagcagcttgcgcgcgctcccttgcctgccctcccccgacgccggacgcgcgccgggcggggcagctccgctggtccgagggcagtgcagcagcggcgacagcggctgcggccgtggccgtggcgggaggagccggaagccccgcccccggggaggggccgtcctgcaggtcccccctctatcctccacggccccatccaagccagggatgaaatttaacggcaagaagggcgcagttgacgcggcgtcaatgaactgagactaagtcaaaagccgggccctccaaccctatccccatcagcctggtcatcaccggcgtcacccccgccccgcgccctgcccctaggttcctgtgccagcaagatgctggagcgaggcgcggagtccgcggccggggctaccgatcctagtcccactggcaaggaaccagtgaccaaagaagctccccaccagggcccaccgcagaagcccagccagtcagctccagggcccaccgcgtccgcgggctcgcctccccggcctcgccggcggcccccgccccagcgcccgcaccgctgccccgactgtgacaaggccttctcgtacccgtccaagctggccacgcaccgcttagcacacggaggcgcccgaccccacccatgcccagactgccccaaggccttctcctacccctccaagctggcagcccaccgcctcacgcacagcggcgcccgcccgcacccgtgcccacactgcccgaagtcctttggccaccgctccaagctggcggctcacctctggacccacgcacccacccgcccctacccgtgccccgactgccccaagtccttctgctacccttccaagctggcggcccaccgccacacgcaccacgccaccgacgcccgcccctatccttgcccgcattgccccaaggctttctcatttccctccaagctggccgcccatcgcctatgtcacgaccccccaaccgcgcccggcagccaggcgactgcctggcaccgatgctccagctgcggccaggcctttggccagagacgcttactgctccttcatcaacgcagccaccaccaggtggagcacaagggggagagagactgagccctcccttggctcactgtccccttctgccgccagccctagccagtaagaggtgggatttctaagaccgactgtatgagctcgcctcttccagatagctggcagagggcagggcaagggattggccatttatactgggctcgagctcagaagcccgaggaactctttgctcccctgctttggggagatctcaaaccatggacgtggagctgtggtttgacagcgctggctctgcttctccccacacacttacatggcaaaggtaaaaagtctgctactatcgtgggttgatgaggattgtgggcaaacaggctctcttgttaaaagtttaaactggtgtctccactttggccatatgacggtatctaagaaattgaaaatacatacatgcttgtctcaactcttccacttgtaggaatttattctataaactcatgaatgtgaaaaaaaa

SEQ ID NO: 543 - DNA, 1333 bp, Homo sapiens
ggggaggcgcggggcggtcggctgcggtggcggcgtttggatgattgtctctcggcggcggagtcggatactgtggcgtatgaggacctgtctgaggactatactcagaagaaatggaaaggtctcgcactcagtcagagagccctgcactggaacatgatgctggaaaatgaccgtagcatggcttctttggcaggtaggaacatgatggagagttcagagctgactccgaagcaggaaatttttaaaggatcagagtcatctaatagcacatcagggggactctttggggtggttcctgggggaacagagactggagatgtttgtgaagataccttcaaagagttagaaggacaaccctcaaatgaagaagggagcagactagaaagtgatttcttggaaataatagatgaggataagaaaaaatccacaaaagacagatatgaggaatataaggaagttgaggaacatccacctctgtcttccagtcctgttgaacatgaaggagttttaaagggacagaaatcctatcgatgtgatgaatgtggcaaagctttttattggagttcgcacctcattggtcatcggagaatccacactggagagaaaccctatgagtgtaatgagtgtgggaagaccttcaggcaaacctcccagctcattgttcatctcagaacccacacaggggaaaagccctatgaatgcagtgagtgtggaaaggcctataggcacagctcccatctcattcaacaccagagactccataatggggagaaaccctataaatgtaatgaatgtgcaaaagcttttaatcagagctccaaactcttcgaccaccagagaacccatactggggagaaaccttatgaatgtaaggagtgtggggcggcctttagtcggagtaaaaatcttgttcgacatcagtttctgcacactggtaagaaaccttataagtgtaatgaatgtgggagagcattctgttccaatagaaatctcattgaccatcagagaacccacactggggagaagccttataaatgtaatgaatgtggcaaagccttcagtcggagtaaatgtcttattcgacatcagagcctccacactggggaaaagccatacaaatgtagtgaatgtgggaaagccttcaatcagatctctcaacttgttgaacatgagcgaattcatactggagaaaaaccatttaagtgtagtgagtgtggtaaggcattcggtctgagtaaatgtcttattcggcaccagaggcttcacacaagtgaaaagccctataaatgcaatgagtgtggaaaaaaaaaaaaaaaaaaaaaaaaaaaaa

SEQ ID NO: 544 - DNA, 2644 bp, Homo sapiens
aatgctccggcagtcctgttccttcccggttacgtcccttccagcccttggcggagtctgcgggcgagagggcgcaggtgcagaggtgccgccggcggcgtgcggctgcgaaggaagggaccccgacaccgagcgttcctgcggacgctcctcaaccgggggttgttctccgtgctctggacccggcccttcctcacctaggacgtctcgcggtgcactgtccccctctctcgggcgacttttcccccacatccaagtagtgatcaagctcagaatccagctcgcgcccgctgtgcacctagcacttcccacctgtagtcttttgacctcatcgccccctctagaaggctgctgccatcgcttaaatgaggaagccgaggtgcagagaggtttcagacctattgcggtggagctggagttcgagaaccaaccactcggtgctgagacgcgcttgcggaacgggcggcgggcgggggtgaagcggagtgaggggagaggccaggtgcgacccgggcaggtgaggagcacgggcccggagggaggacttacgagaatggaaaggaaagcagcccgtcttcagtgggacagtgggagcattaagatgtcagagaatgagcagttgtgggaagagccatagggtattttattttttagagatggggttttgctctgtcgcccaggctgcaacctcgacctcccgggctcaagcgatcctcctgcctcagcctcccgagtaactgggactacaagcaacgcgccaccacactaaatctttaattttttggggggaggttgaaggtgggggcgggacagggtctctctccgtctcccaggccagagtgcagtggcgcaattacggcccgactcctgggctcaagcgatcctcccacctcagcctccggagtagctgggaccacaggcgcccaccaccacgcccagctagtttttgtatttttttgtagaggtggtgttttgccatgtttcccaggctggtcttgaactcctgagcgcaagtgatccacccgtctcagccttccaaagtgctgggattacaggtgtcagccaccacgcccggccctaaatatttttttaaaagttggatttttcatggtgcccaagggaagagacactcctttccttttactaagaccatttcttttagaaaactttgtaataggaaaatctttctttgccctcttgaaatgtatgtaaattttttaaaaagctgcataagcctcttgccagttttataaaccaggaatttctttcttaaggacctttcttaaggaccttggagtgatttctttgaaataaaaaggccaaggaagatagcttccctccttgtctctgtgggagtttagcagatggctggctccaagttgcaattacctgcttgtcatagagacatgaggtttattttaactttggataaaggcagttagctaacacagatggccgccccaagtaccacgtacctgccttctcgtttagaaacactgtgggcattaggggcaactcatgcagaagacccaggaatcttccaggtatactccatgggatgcctgttccactctggcccattggcacaagctagccttttcttttaaggatagtggggtccgttctgagagcggcctttgcaacatctcacttcccctgttgactgttatttcttttcttcctgctttcctactcccttgatcccaaactcactaggggtatttagtgagcacttactgttgcagtaagactgtagccaaggaagacgaagagacagttggagaccaaagagaacttcaattcgggcacccgagcctagagcaggctcatgcccaaaatggctaccgacccagacaaagaaagcaggcttgcttatatgtcgtttcaggcgtgaaaaacaaggcaggatacaagtttcagacaaagacagtaaattattcaacctgtgacaattctgagaaaacttacatttagttatcttgaccagtcaaccttgaagctggacagagctggggtaagggaaaacaggaattacggaagtatgagggagtcgcgaggccggagataagcttggaaggttgagataagctcgcaggtgcaacttcttagcaatgctgagagtggctgcttaaatttcttagcctatgtataacttctaaatagcctacactaaatggtaactattacctatgttgtgtttgttattttaaactttaatgttatttattttatttcattttccttccacattacctctgctgttagcagctttgagaaatgctgctataggatgtgggaggtcattaaaggatttaagcagggagaggcaagatcagattaacatttcagaaaaatatttactgttttccagctgaaactagtagagtacaatttactttctggtcacagcacacagcagtcacatcctggaggaactgtacttctctaagatctagtctgtcctgtggtttaaatgacctttagcaaattgtctttattactttgtacactgctttcaccagtctgctcttccatggctaacggggcagaactgttatttttagggttttccacatccagtatgttcataagatttctaccctgtgtgaacttccagatgtcgaataaaggctggatgctgacc

SEQ ID NO: 545 - DNA, 907 bp, Homo sapiens
agatctgaaatctcattttctgtgtggctgtgtgtttgggacaggggtaaccaattcctgactactctatatgctgcatagaacctggagaggatttttcaaagtaaatgaatctcgaaagctggattgcagagcaaacgagtgcagtcaattcagccaggggcttgcaagaggagaaagagaaaaagactgtggaatggaaagtttcccaacccaagcctttcccaaggggtagccattctctgttctacagtttagggcttgcatgtgctttttctggagtccaaaaatacataagttataaccaatttaacagacagaaaggcgcacagaggaatttaaagtgtgggctggggggcgaggcggtgggcgggaggcgagcgggcgcaggcggaacaccgttttccaagctaagccgccgcaaataaaaaggcgtaaagggagagaagttggtgctcaacgtgagccaggagcagcgtcccggctcctcccctgctcattttaaaagcacttcttcttgtattgtttttaaggtgagaaataggaaagaaaacgccggcttgtgcgctcgctgcctgcctctctggctgtctgcttttgcagggctgctgggagtttttaagctctgtgagaatcctgggagttggtgatgtcagactagttgggtcatttgaaggttagcagcccgggtagggttcaccgaaagttcactcgcatatattaggcaattcaatctttcattctgtgtgacagaagtagtaggaagtgagctgttcagaggcaggagggtctattctttgccaaaggggggaccagaattcccccatgcgagctgtttgaggactgggatgccgagaacgcgagcgatccgagcagggtttgtctgggcaccgtcggggtaggatcc

SEQ ID NO: 546 - DNA, 653 bp, Homo sapiens
ctgacgtagctgatcggcccggaagtgctcacacgtgtgctccctgccctgctcctggccccttggccggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggtctgcaccgctgtctggcctgcgcgaggtacttcatcgattccaccaacctgaagacccacttccgatccaaagaccacaagaaaaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgccccaaataaaggaactggacaaagagaaaaaa

SEQ ID NO: 547 - DNA, 1852 bp, Homo sapiens
ccagacctggtccctgctgtgctctcccgttggatctctgacatggaggaaatgctgtccttctgggatgtggccattgatttttctccagaagagaaagaatgcctggaccctgctcagtgggatctgtacagggatgtgatgctggagaatttcagccaccttgatttcctgggtcttgctgttgctaaaccatacttggtaacatttctggagcaaaaccaagggtcttcgggtgtgaaaagccaaacatcagccaccattcctccaggaacaacaggcaatgaatttaacaatcacaatgaggccattgatcacagctctctaagtatgcaatgccagagaattcatacaggagaggaaccctactactttgaagactgtggtaaggcccttagttctcaggcaacactttctgtactccagggacattttattggagacaaaccctacaagtgtagagaatgtcataaaacacttagcagtcgctcatcacttttaatacaccagaaatatcatactgatgaaaaaacctacaagtgtgaaaaatgtggcaaagggtttttccgttcctcagatcttcagcatcatcaaaaaattcatactggagagaaaccatacaaatgtgaagagtgtgacaaagcctttcttcatcactcatatcttaggaaacaccaggcagttcatactggagagaaaccctacaagtgtgaagagtgtggaaattcattttactatcctgcaatgctgaagcaacatcaaagaattcattctggagagaaacttgacaagtgtgaagaatgtgggaaagtattttcctctgctttctttcttaaccagcataaaggaattgattccggagagaaaaggtacaagtgtcaagaatgtggcaaatccttttgctatcgttcatatcttagggaacattatagaatgcattctggagaatatccctacaagtgcgaagaatgtggcaaagggttttcccgttcctcaaagcttcaggaacatcaaacaattcatactggagttaaaccttacaagtgtgaagagtgtgggaaatgtttttcctcttttacgtcccttaaaagacatcaaatcatccattctgaagatactccccatgagtgtgtagaatgcggcaaaaggttttctagttcttcccgccttcaggaacatcagaaaattcacactgaagagaaaccatacaaatgtgaggaatgtgacaaagcctttctttatcactcgtttcttaggagacacaaagcagttcatactagagagaaaccctacatgtgtgaaaagtgtaggaaatgtttttcttcctttacatccctgaaaagacatcaaatccattccatagacatttcccatgagtgtgtataatgtggcaaaagattttctagttcttcccacctacaggaacatctagaaattcatactggagaaatcatacaaatatgaagactgtcacaaagcctttctttatcattcatttcttaggagacttgaggcagttcacagagagaaaccatacaagtgtgaagagtatgggaaatgtctgttcttttcttcaacccttaaaagacatcaaataattcattatgaagtcagtctctacaagtgtggggaatgtttaaagctccttgtatgctgtccactcttaagaaacacaaatttgttcattttggagaggaacatacaagtgtgaccaatgtcagaaagccttgtcttttgtaatacttctctatttgagcacaagctaagtcatactggagtgaaattttcctagtttgaagaatataccaaaatattttactctaatttataactgaaaaaaaaaaaaaaaaaa

SEQ ID NO: 548 - DNA, 1591 bp, Homo sapiens
ccctcgcctacagaggcggcgctgtccctgatcgagcggcgggagcgagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaaaaaaaaaaaaaaaa

SEQ ID NO: 549 - DNA, 2755 bp, Homo sapiens
cagaaaggcacatgggcggggctgcgaggagcaggcggggcgggggcgccgaggagagcggcgcggcgtgcgcgggcacgaggcgtagtggtctcccctaaggctgaggcggcggcgggcgcgcggcggcggcgggcgtgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacaggataaatggttttagaaattctgttctaactttccacattatttgccttataaaaatctaatgaattcatcagctagaattgcaagtgcaattcttatatccctttctctgctcagtggcaggttcctcagttaaactagagcagactgattcattaaaattgtgcatacgattttatgggcagctgatgatctaggtgaaaaatgacttatctgctgccttagtatattgcggttatgtgtcattgtacccctctgatcatttcctgtgtttgagttggaatatttaaaattgcagtatgacctggctctaactgccagtcaggtgtaccctgtagataactgatagcttcctaaaagcggttggattgtcagtgagcccttgtgaaaggttaggttctaatgtatatgccgtaatgaaataatcattaagcctattgtttaatgcaaaatatggaacaaatgtgaactggtaaaggtcgatcttgatactatattctttgaaaattcttgaagttctttaatttgaaattgaaacattaatttttgaggtttttggaagttactatttggccatttttacaaatggattttgcattaacaggaagattggaatgacttgtggctggattaattcccagaaccctctccctcctttcttttctaagtgagttgttgattttaggagtttgctttgtgctgttacctaaaatcagagactggtgtacagtatgacttccatctgaacttgaaaagtattaaaatgggtcaatattcacattcttttagatctcaggatgggaaaatgggtttgttcagatggatatggtaaatcttacccaattaaggaaggctaattttagagttcttctaatttgcttgtgtcaactcttaacttgtaaaactgctgttaactcggtttaaatttttaaattaatataatagaaagaacactaaaatacttactggtaactgcttagagccatttatctgatcctgtggattacagaatgcattccctcttctgctgtagcttatcattgctttgttttgtagctctgcatattttgcccaccttgtcttccctgtaagtttaagacgtttccaaggaaaagcttcagggctgatagtttcttagcaattcctattcttatgcccttactttaaaatagtccttttattttgtgtattttatttcctaagtttcagatgtaatatctgttgtttcctaacatgtcgattaccagaacgttagaattttacctaatttcttgtggatattgcagaagttctggttaaatcacaacttaaaagtttttaaaagtgctttgagcatatgtatatgtttagtgacaaatcatataaaaccattcacaagttttggttttttttttttcgtttgttttagtgactaattcaggatgaaagtttttttgttcttgtatttaacccttttttataagcagctgaagacaccatatttaacactatatctcagtgatagggaaatagctgcattgatcttacatgagcataatcatccttatacttcatgaggggattattagtacaatccccattttactgtgtttgagttaaaaaccaaacatccctgtaatttaatttgaagattctttaacagattgcagcaaagttcattataaaactgttatggtgtcttcaaagacttgataaaataacactgagagagaattggtccatttgtatgctgtatttctattacttgccaaaaggaatggggttaagattaaacttgtttccattctcttcacatggatatacatccccatgtttaactgacacactgggggctcagttgtgtgctgtaatgtcttattaaagaagatattaaagaaaactaaactagtctaaaaaaaaaaaa

SEQ ID NO: 550 - DNA, 1102 bp, Homo sapiens
actggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaagcaacaaaaaaaaaaaaaaa

SEQ ID NO: 551 - DNA, 3013 bp, Homo sapiens
caacgagttgtagccgcggagagcaggcgtcgatgctggcgcccaaagcctccagcctgagagtcgcctcactcgtgtgacgacagagtttcactcctgttacccaggctggaggacagtgatgtgatctcgggtcaccacaacctccgcctcccggattcaggcgattctcatgcctcagcctcccgagtagctcagattacaggcatgtgccaccacgcccggctaattttgtattttcagtcgagacggggtttccccatgttggtcaggctggtcttgaattcccgacctcaggtgatctgttcgcctcggcctcccaaagtgctgggattacaggcgtgaaccactgcacccggcgaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacaatatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaattgcgtgatagtttgtagtttcaaccactcttggtgactgtcatcctgtttcttccatattctctgatttcatgaattgaaaagaaacaaatgtattgaagaagtgagctacagttttccttccttaaccatgggtgctagtaactttttaaaactcaagacaagattagttttttatgtgtgaagtcattaaattattacacgaccagaactaaaatgcaatatacagttaagtccacggatactcccattaatgagaaataacactaggaagccactattacaggaagaaaagatttggttttcatggcagtctgtttttttaaaaaaaaatttttgagccactatctattgttgaatattttaagatgggatgagggaggaactaataagggcttacacaataaaaaataactatatcataactcattcataacttgatgtttcattttctgttgaggaaccataaattcattcacagacttaatatttttttcttagagatggtctcgttctgttgtccaggatggagtgcagtggttgatcatagctcccgggccgtagtctcccaggctcgagcaatcctcccacttcaccctcctgcatagctaggactacaggcatgtggcaccatgcccgctaagtttttaaatttcttgtagagatgagatctcgctatgttgcccaggccagtctcaaactcctggactcaagcaatcctcccaccttggccttccaaatcactgggattataggcatgagccattatgcctgactcttgcccaaatttctgatgtcaaattgttcattgacagaaaacccactgaagtatttaaagttaggaagatctgggagataggggttgctggcatgaaaatgtataacttacaacatttattaataaaatgataaattagc

SEQ ID NO: 552 - DNA, 1680 bp, Homo sapiens
cacggcagccctacactcggcctggaagaattgtttttcttctctggaaaggtgaacatttatagcatttatttcccaaatctgttaacatggcaaaatatgtcagtctcactgaagctaacgaagaactcaaggtcttaatggacgagaaccagaccagccgccccgtggccgttcacacctccaccgtgaacccgctcgggaagcagctcttgccgaaaacctttggacagtccagtgtcaacattgaccagcaagtggtaattggtatgcctcagagaccagcagcatcaaacatccctgtggtaggaagcccaaacccacccagcactcactttgcctctcagaaccagcattcctactcctcacctccttgggccgggcagcacaacaggaaaggagagaagaatggcatgggcctgtgccgtctttccatgaaggtctgggagacggtgcagaggaaagggaccacttcctgccaggaagtggtgggcgagctggtcgccaagttcagagctgccagcaaccacgcctcaccaaacgagtcagcttatgacgtgaaaaacataaaacggcgcacctacgatgccttaaacgtgctgatggccatgaatatcatctccagggagaaaaagaagatcaagtggattggtctgaccaccaactcggctcagaactgtcagaacttacgggtggaaagacagaagagacttgaaagaataaagcagaaacagtctgaacttcaacaacttattctacagcaaattgctttcaagaacctggtgctgagaaaccagtatgtggaggagcaggtcagccagcggccgctgcccaactcagtcatccacgtgcccttcatcatcatcagcagtagcaagaagaccgtcatcaactgcagcatctccgacgacaaatcagaatatctgtttaagtttaacagctcctttgaaatccacgatgacacagaagtgctgatgtggatgggcatgacttttgggctagagtccgggagctgctctgccgaagaccttaaaatggccagaaatttggtcccaaaggctctggagccgtacgtgacagaaatggctcagggaacttttggaggtgtgttcacgacggcaggttccaggtctaatggcacgtggctttctgccagtgacctgaccaacattgcgattgggatgctggccacaagctccggtggatctcagtacagtggctccagggtggagaccccagcagtcgaggaggaagaggaggaggacaacaacgatgacgacctcagtgagaatgacgaggatgactgacgtcctctcgccttaagattcagcttcaggaaaacatttagggaaaagaaactttttttttttttttaatgtgaggttttctgtttcttttttgcctactcccaagaagatattggtaagctatagaatttagatatgcacctctgataagcaaggattgtttcccgtatgattaagacgtgctgttgatgtgtgttttgataccagtgtgctgacacagaatctttatttactttttaggattttgtgttttcattttctatttttctttaaatgcagagttcattgttgccccttaacagtttttcctgagtttactgaagaaattgtacttcatccacatccatgaaaataaaatgctctccttttgtgc

SEQ ID NO: 553 - DNA, 1781 bp, Homo sapiens
agtcgcttttgttctcgcgatatttccgggtacgcgggagccccggcgacccgggcttctgtgaaacatggcggtaggctgggaccataacacaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaaggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaacatacggaaaactagtctagactttaaagaattgtgatcaggtcacattgttaataaaaaaaaaaaacgggctaaaaa

SEQ ID NO: 554 - DNA, 1473 bp, Homo sapiens
gctccaggtgcttgggagtcgggggactgcggaggacgccaagtctgagctcgccgccctctccgagccgtttgggccggacgcctgggtccttcgggctccgccccagggggtggggctatatgttcggaccaatgaccggccgtccctgcggtcccgccccctccccgcccccggagccgcggcctcgctgagtgcccagccgcccggcgcccaggcctggggcaccgcgagtgccgaaccttcggctgctccccgcctcaggacaccaagatgcctggcgaacagcaggcagaggaagaggaggaggaagagatgcaggaggagatggtgctgctggtgaagggtgaggaggatgagggtgaggagaagtatgaggtggtgaaactcaagatccccatggacaacaaggaggtcccgggcgaggcgcccgcgccgtccgccgacccggcgcgtccccacgcgtgccccgactgcggccgcgccttcgcgcgccgctccacgctggcgaagcacgcgcgcacgcacacgggcgaacggcccttcgggtgcaccgagtgcgggcggcgcttctcacagaagtcggcgctgaccaaacacggccgcacgcacacgggcgagcggccctacgagtgccccgagtgcgacaaacgcttctcggccgcctcgaacctgcggcagcaccggcggcggcacacgggcgagaagccgtacgcatgcgcgcactgcggccgccgcttcgcgcagagctccaactacgcacagcacctgcgcgtgcacacgggcgagaagccgtacgcgtgcccggactgcggacgcgcctttggcggcagctcgtgcctggcgcgccaccgacgcacgcacacgggcgagcggccctacgcttgcgccgactgcggcacgcgcttcgctcagagctcggcgctggccaagcaccggcgcgtgcacacgggcgagaagccgcaccgctgcgctgtgtgtggccgtcgcttcggccaccgctccaacctggcggagcacgcgcgcacgcacacaggcgagcggccctacccctgcgccgagtgcggccgccgcttccgcctaagctcgcacttcattcgccaccgacgcgcgcacatgcggcgccgcctgtatatttgcgccggctgcggcagggacttcaagctgccccctggcgccacggccgccactgccaccgagcgttgcccggagtgtgagggcagctgagtcccgcagggctgcggaggggcgcgctggggcttcgacctggctgcactaacccaggctcctcctcgccccggcctccgggtctgggaaattgaggggacggcaggcccggctgccctggaactgggagacagggagaatcccctgccggggtccctggaaacagtgcccaccccacatcactacattccctcggcccgtgttagtgaataaagtattatatcctcaaaaaaaaaaaaaaaaaaa

SEQ ID NO: 555 - DNA, 4807 bp, Homo sapiens
aagtgcgcatgtgcgcgaggagtcgctcgggcacttattgagcgccgactgtctacgggcggccgggggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaaaaaaaagagtttctggctgatgggtgactcagagtgcaggactgcctggccgtggggcagaggggtttgcccttctcggagggtacctcctgttccctgtctgagcatcctgcatggaagtcaaaggaaatccctttcttggtgacgacttaaatctgggttccctcagacattgggttgcaccccaacaaatattaaatggcttcttcttaaagcccagagaaagaggttttttaaaagactgtcgccaaatagctgagccaaaaggctgatcagaattcactttttggaatgtggcagttaaacactaccttgatcattctctcctctttcctcgaggaactcctggagggtttgagcgtctggaaactctctgctctgacccgaggaagcaccctcctgacgccgccttcctccggttattgaaaggacgcctcagaaatgctttgttttcttttacgatgtattcagaagcctttactgattaaagttttcttttatttgggtggccgggagagacccagggaggttctggaggttcctttctgtctcctggccccaccagggatttccccatttctgtttgctgcctgaaagcaggatgaggaaggccaaggagagtccttgcacccgtgagcgtcaggatgaggaaatgacaggaggaagacgtgggtttgggttagtggctgctggcgttttggcccttggtgtttctggagcctccagggatctaggggagcctgggctgcgtgcatgtcgataagcagagctgttcttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgcccactgcccagctgcctcgggtacaagtcctggccctatgtcccagctgtcaggggctcagggaatcctacccagccacctgtcctgggatggagtgtcagcatccaccccttggttgtcatcgaggccgccctcccagtcctgggtgaagatatttgggccaccagggctcccttggccccttcacgtaggaaatagacacgtgctttttaatgcaggacactttgagtgttacaaaatctgtagacctggcagtagggtcatgatgttgggaagggtgtagtgccctaggttggtgacagaagggacagacacttgtgcacaggtgtctttggtgatggggtttttttttttataacttagtaaaaaaaaaaaaatgtatgtggaattctgtctcttggtaaagctcaaagccaggctagcctgaggtggcgcagggctctccttcctgtcccttcgatctccttgagaattaagagctggcagctgctgatggtgtttcccaacccccctcacttcccaagacaacccccagcttcaggtcctcatggggaggggagggcacgttcttgacacatgggaacttcgctcaggagggcctccccttcccctctccctcagagttttcactgccgtctcgtctttagaaagctgtttgaattccccccgcccccagtttggaccgtgtagatataactggatatacggatttttctctttgtgcaggcttcttatgccgttggtatacagggcaggaaagagaggaataaagggagagagcagtgtggaaaccacggtggttttgctttgttcttactaggttttggtgccaccttccctgcctgcgcttgtgccccctctcctccttggcactggcggcctccttgcctcccttccacccgtgctgccatcccgtgcctgtcgtgttggttcttcacacgtgctctgttctcggggttgttccattcatgccttcttggagggtgagggtggcttgggaaccgacccagtgatcatgcctactttcttctttgtatctccctccttcccagcccacccgggcagcagactctgatggaaggaaggtgccgtaggtgggcttttagaaactaacgggactggttttcaaagcagttatcttgggaaactgtttattccagcgatgtgacttttttcagaatatttcttggaatcatattcagagtctggggctgtgtgttgagcagccttaaggatgctagacactcatttagtgcccagggagtccagcgaatgacgtctgtggccaagcgaggtctcaggtgcaaagcaaaaggaccatttaaagtaaaatagcttggattcaatcatgtgacttttaaattggctcagaaagcaattttgtaatttcagagagtgttttgagccatggccacgttgtcattgtgagtctatagcttgactccttggagaacaatattcatttggttgtggagactgatttgctgggagaaatctgtcctgttactttctggtcatcccaggttctgacttttaccaggggcaaaaaaaaaaaaagcaagagggagataaatcccatctgtgagtttgtcttattggcgcctttttcctcagctgtcttccaagtattatttttactgttaaaaaattttttaaaaatgtgaaatgtaatgtttttacagcaacaatatgaaatatattttataaggaataaaatggtaccttgtctgatttaaaaaaa

SEQ ID NO: 556 - DNA, 2596 bp, Homo sapiens
gtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaatgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagttctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaaaaaaaaaaa

SEQ ID NO: 557 - DNA, 1869 bp, Homo sapiens
gcgagtcctcagggcgcccgggagccaccagtctgctctcgggctctactcagactagcgccaacagtctccgcggacagactcgcatcagccgccctggggctcggcctcctcccataggctcctcttcctctctttcattcaagtcttcaaactttgaaaaaaatatgagcttttgccaaataagacgggatagtttatggagttttctgaggcgcattgaactctggtcagcccctcgagcgtgggctcggccatcagcaggcccggtgggttggccgggctggccctcccaggctgcctttctctctggtcgcggcctggcccgccccggcctccaccgccgcaattcatgctggtgccgcacccgcagccccactcctggtatgcctgagattctccaggggccaagccggtcctccttcccggcccactcttccagggccaggacgctcccgcggagccagcccatcgtggctgggggtcccaggggctggaggcctgcctggttagcctctgtttcccagacattgactcgaggcgcctccagtcctctcaaccccctgactttcaagtcctttcaagtccttgtgccctgaccaagttatgaggaaaagagggctgagggcctggaggtgggctcgcaccccctcgaacccacctagatgtctcctcctccccagcctatgagttcagacttggggggctccatctgtccctccctgaggtccctcatcttgtccctgctctgattctgtcagcagatcctgaacactccttggtggggacccatgcctccaaggctgcccccaatgccagctgtcctggggaaactccccagaactctcggggaaaggcccgagaaccttcggaggaagcctccgggactcctcgccacctgctctgtttctctcccggccccactgccttcaggtatcaggaagagggcaggcccctgtgccccctctccccttcccagggcggccaacaatactccaccatggggcgcttcctttcttctctggaaactaagacattggactgaaggaactggcctgaggggggctgaccgggggcccgtgctgctgggagctctacgcacaagaggccgccggggtcacggacaggaacctcagcccagggtgctggcctttctccttcgcaggagtcccccaaaatccacacagcgactcgagcagccttccactcagccagaggagggtcgggctcccccgcctgctctcggtggtggcgtctggcccttcctgccgtttccaaggcctccggaagcaccaacccagttctcagttacctcctctggccggaaggcctcacgttgtcctccagagctgctctgggcccagggctggctccgtgaccacctgatggacgtgctgggcagcatgggctcccaaggcagcatccccagctgctctcccaccccaccccagctgcccggcggctgggcccacgagggctctggggacacttccataggaaaggggcctggcactttgtgattgccacgtgtttcctgttaagccgcctgcccccagtgcaaatctctgtgttttgctctctcctgaacaaaaatgtaaaccgacgccggaaagcaaatggtatcgaatacctttcttgcccataagggtttttacaaagaacgtgtctcactaggaactaggacactcatcggcccgagaccaactcctggataaaaggaataaggagaatcgtgtttgtaacgagttacaggattgtttctttcctggattttaaacttttgttaaattgtgaaattatggaggagttttatagaaaaaaaaagtgaaataaagtcagatgggaaagccaaaaaaaaaaaaaaaaaaa

SEQ ID NO: 558 - DNA, 2871 bp, Homo sapiens
gatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagcaagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgtgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataagtgtaatgaatgtgggaaaaccttctgtgaaaaatcagctctcactaaacatcagaggactcacacaggggagaagccgtatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcagaaatttgtagaaaatgacttcttgtttgaatatgtaaaagctttcaagaaaaattaaaacttttcattagaaaatttgtactgaggggaattctattcatctaagtaatatggtgaaaatatttatctggaatttatgttgtttagtgttatattccagacgtgataccaaaattttgttgcaaatataatggacaatatttatttatacccatattcacagtggaatctgaagcttataaaagttgaatgacagcagcattaaacatatatgtgaagagtccccgatgtttgtagaccttatgtgagtatgcaaatatataaatttgagtatgcttgatttgtatattggaactcaacatgatcataaggagaagatacgtacccttaattgagtaactactatggtatttgttaatattttctacactaaataccattggtgtctttataggttgacataattatatatgtgtatgtacatatgtttgtgtgtatatgtaaatatatttctacacacatacttaaatatagtgatgtgctagtataacctcatactgacttaaaagttctgattgttaaattttaaggaattttgtgagccagttattaaaagcagtcattatttaaaatatgtaaacttacagttaaaaacaaaggtaataaatactcagcactcatcacttcctaattattttgctacatttcactattacctttgctgttttacttatttaatctgtatgatgaaaatactgtataatagtgtgcactgcacatctgtctcttcccagctccacattcagtgctgtcttggtagcttggacttagtgggagtgtttacaccatggaaattgacaaactataaatcagggttttaattttctcagagaacctgctgtcaaatatttacagcacatcactgtgtatatatgaaaacgtatttggcaatacaaaccacataccccttctatttcctgacataaataaatggctatggccatttacagctgaaccacgtcttcaagaaagaagccaaaaatatttccgtgaggtttttaactacctctgaatctgtcctactctaaatactaccggagtctctttgtaggttggccagtatatgtttttagtgaaatattatttcacaaagaactatatcacgtacctttcctctgactgtttcctggcatatatgcatgaatatggccattattgaactatcacttcagtaaagaagttaaacagtacttttctgaggtttttcagctacctctgggtcattctgtaatgtaaatgttgttaataagaatggtttttacataaattatgcaaaggttaacaagcagtaacactgcactcctcaaaaagtggcggtatgtaatgaaaggcccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgtgcatccttctcccagatgacttaggtggtaagtccagattagtcaaagctaatcatggaagttccattttaatgattctgttggggtgaacttgggagcaatgagatgtttgggaagtattgtgtagtacttctgggaaagatc

SEQ ID NO: 559 - DNA, 962 bp, Homo sapiens
gggaaagaatgcggagccgggttcacacaccccgcggcggcgaggccttaaatagggaaacggcctgaggcgcgcgcgggcctggagccgggatccgccctaggggctcggatcgccgcgcgctcgccgctcgcccgccagcccgcccgtggtccgtggcggcgcgctccacccggcacggggaggcgcggggcgcaccatggccgcagacacgccggggaaaccgagcgcctcgccgatggcaggagcgccggccagcgccagccggaccccagacaagccccggagcgcggccgagcaccgcaagtcctccaagccggtcatggagaagcggcgccgagcgcgtattaacgagagcctcgctcagctcaaaaccctcatcctggacgccctcagaaaagagagctcccgccactcgaagctggagaaggcggacatcctggagatgaccgtgagacacctgcggagcctgcgtcgcgtgcaggtgacggccgcgctcagcgccgaccccgccgttctgggcaagtaccgcgccggcttccacgagtgtctggcggaggtgaaccgcttcctggccggctgcgagggcgtcccggccgacgtgcgctcccgcctgctgggccacctggcagcctgcctgcgccagctgggaccctcccgccgcccggcctcgctgtccccggctgcccccgcagaggccccagcgcccgaggtctacgcgggccgcccgctgctgccatcgctcggcggccccttccctctgctcgcgccgccgctgctgccgggtctgacccgggcgctgcccgccgcccccagggcggggccgcagggcccgggtgggccctggaggccgtggctgcgctgaggctgtggccctgagactgcatcggaggcggcgccccgttctagggccgtggcctttgccgagactgtagcagagaaaacgtatttattattccaga

SEQ ID NO: 560 - DNA, 1293 bp, Homo sapiens
acacaggtgagaagccctatgagtgtaatgagtgtggaaaagcctttagagtgagctcagatcttgctcagcatcacaagatacatacaggagagaagcctcacgaatgtcttgagtgtcggaaagccttcactcaactctcacatctcattcagcaccagcggatccacacgggagaaaggccatatgtgtgtccgttgtgtgggaaagccttcaaccatagcactgttctgcggagccaccagagggtacacactggggagaagcctcacaggtgcaatgagtgtgggaaaaccttcagtgtgaagaggacactgctgcagcaccagaggatccacaccggggagaagccctacacgtgcagcgagtgtgggaaggccttcagcgaccgctcagtcctcattcagcaccacaacgtgcacaccggggagaagccctatgagtgcagtgagtgtgggaagaccttcagccaccgctccacactgatgaatcacgagcggatccacaccgaggaaaagccctatgcatgctacgaatgtgggaaggccttcgttcagcactcacacctgatccagcaccagagagtccacactggggagaagccctatgtgtgtggtgaatgtggcacgccttcagtgcacgccggtctctgatccagcatgagagaatccacacaggtgaaaagcccttccagtgcacagaatgtggcaaagcttcagcctgaaagcaactctgattgtgcacctgaggacccacacgggcgagaagccatatgagtgcaatagctgcgggaagccttcagccagtactcagttgctcatccagcaccagcggatccacacaggcgagaagccctatgagtgcggggagtgtgggggtgccttcaaccagcatggccacctaatccagcaccagaaagtgcacagaaagttgtgacccatggctgacacaagaatccattctcacagaaactgcatgtggaaccacaagcagccttcagcccaagagaagtctctgttaactctataggaagcttttctttggcgattcagtgtcacaaaataactccagaaagaagcacttagcgtgctgttcctgtggaaaaacttcagagactacctgttttattttcctcaacatcttgaagttatgttggagagtaatcatacaattgtagagaatttggtaaaaaacagccataattctttaacattagtttatttgaactaagggaatttaaggcataagaaccattatcccaataaaatcttacattccaaataaaaaaaaaag

SEQ ID NO: 561 - DNA, 1976 bp, Homo sapiens
ggccgcgcagtgccggaacccggctgcagcggtgggaaggcgggggcgtgccggcccagcggggagagggggctgctgagagtaaatacttggcgcctccagctgctggccaaggagacagatggagctcaagttgggagatacgccctgagagccgatgatagacacaagtccagatctcggattttgatactgtatgttccctgggttcctgagagaggacattgaggagtaggagtcggcgattaaggagatcggtacaattgggaagcctcctgtcagagcttccagcaatttcctcatcagaggtggacaagccctatgggctaagacagagggtcctcagaaaggagtgcggacgccgtcatgctgcagcagctcctgatcaccctgcccaccgaggccagcacctgggtgaagttgcgtcatccaaaggcggccacggagcgggtggccctgtgggaggatgtgactaagatgtttaaagcagaaggaactgttaaccttcaaggacgtatctgtggacttcactcaggaggagtgggggcagctggcccctgctcaccggaatctgtaccgggaggtgatgctggagaactatgggaacctggtctcagtgggatgtcagctttccaaacctggcgtgatttcccagttggagaaaggagaagaaccatggctgatggagagagatatttcaggagttccaagttcagacttgaagagcaaaacaaaaaccaaagagtcagccttacagaatgatatttcgtgggaagaactacattgtggcctaatgatggaaagatttacaaaaggaagcagcatgtattccaccttgggaagaatctccaaatgtaataagctagaaagccaacaagagaaccaaagaatgggtaaggggcaaatccccctgatgtgcaagaaaacattcactcaggagagaggccaagagtctaatagatttgagaaaagaattaatgtgaagtcagaagttatgccaggaccaataggtcttccaagaaaaagagatcgtaaatatgacacacctggaaagagaagcagatacaacatagatttagttaatcattcaaggagttatacaaaaatgaaaacctttgagtgtaatatttgtgaaaaaatcttcaaacagcttattcaccttactgaacacatgagaattcataccggggagaaacctttcagatgtaaggaatgtggaaaagcctttagccaaagttcatctcttattccgcatcagagaattcatactggtgagaaaccctatgaatgtaaggagtgtgggaaaaccttcagacatccttcatcgcttactcaacatgttagaattcataccggggaaaagccctatgaatgtagggtatgtgagaaagccttcagccagagcattggactgatccagcatttgagaactcatgttagagagaaaccttttacatgcaaagactgtggaaaagcgtttttccagattagacaccttaggcaacatgagattattcatactggtgtgaaaccctatatttgtaatgtatgtagtaaaaccttcagccatagtacatacctaactcaacaccagagaactcatactggagaaagaccatataaatgtaaggaatgtgggaaagcctttagccagagaatacatctttctatccatcagagagtccatactggagtaaaaccttatgaatgcagtcattgtgggaaagcctttaggcatgattcatcctttgctaaacatcagagaattcatactggagaaaaaccttatgattgtaatgagtgtggaaaagccttcagctgtagttcatcccttattagacactgcaaaacacatttaagaaataccttcagcaatgttgtgtgaaatatactaaacatcaaagaatctatgttggagcacaagattctaaatcagtggttccctgatccctcaaaaatccatttgtttttggatt

SEQ ID NO: 562 - DNA, 1448 bp, Homo sapiens; identical to SEQ ID NO: 439

SEQ ID NO: 563 - DNA, 2279 bp, Homo sapiens
atgtaaacatgtcgaaaaacctatcaacaacagttccttagtttcaccacttcaaaaaatttattctagtgtcaaatcccacattttaaataaatacagaaatgattttgatgattctccatttctcccacaagaacaaaaagcacaaataagggaaaaaccgtgtgaatgtaatgagcatggcaaagcctttagagtgtcttcaagccttgctaaccatcaagtaatccacactgcagataacccttacaaatgtaatgaatgtgacaaggtcttcagtaacagttcaaaccttgtacaacatcaaagaattcatactggagagaagccttacaagtgtcatgaatgtggcaagctcttcaatcgaatttcactccttgcacgacatcagagaatacatactggagagaaaccttacaaatgtcatgagtgtggcaaagtcttcactcaaaattctcaccttgcaaatcatcacagaatccacactggagagaaaccttacaaatgtaatgagtgtggcaaggtcttcaacagaaatgcacaccttgcacgacatcagaaaattcatagtggagagaaaccttacaaatgtaaggaatgtggcaaagcattttcagggggttcaggccttactgctcatcttgtaattcacactggagagaaactttacaaatgtaataaatgcggcaaggtcttcaatcgaaatgcacaccttaccagacatcaaagaaaccatactggagagaaaccttatgaatgtaaagaatgtggcaaggtcttcaggcacaagttttgtctaaccaatcatcatagaatgcacacgggagagcaaccttacaaatgtaatgaatttgggaggccgaggcgggtggatcatgaggtcaggagatcgagaccatcctggctaacaaggtgaaaccccatctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaacaaacaaacaaacaaaaaaaaacaaatgtaatgaatgtggcaaagtcttcagttacaattcacaccttgcacaacatcagagaatacatactggagagaaaccttacaaatgcagtgactgtggcaaggtatttagtcgacttccgtgccttacacgacatcaaagagttcacactggagagagaccttacaaatgtaatgaatgtggcaaagcatttagagactgttcaggccttactgcccatctactaattcacactggagagaaaccttacaaatgtaaagaatgtgccaaggtcttcaggcatagattatccctaagcaatcatcagagatttcataccggagagaaaccttacagatgtgatgaatgtggcagggacttcactcgaaattcaaaccttgcaaatcatcacagaatccatactggagagaaaccttacaaatgcagtgaatgtcacaaagtctttagtcacaattcacaccttgcacgacataggcaaattcatactggagagaagtcttacaaatgcaatgaatgtggcaaggtcttcagccacaagttatacctaaaaaaacatgagagaattcatactggggagaaaccgtacagatgtcatgaatgtggtaaggacttcactcgaaattcaaacctggcaaatcatcacagaatccatactggagagaaaccgtacagatgaaatgtgtgtggtaagatctttagtaataattcacaccttgcacagcatgagagaattcattcatgagagagttcttacaaactgagtatggcaaactcttcatgctaagttctagcattaatcaacatcagagattccatactaaagagaaatcatagcaatgtatgtgaatcaggtctcttgaggcctgccaaatgactagatatcaaaacatacatcttggatgaaaccatacagatggattatgtatgctgaggctattattcaaggaccattactatggaacatgataagatttacacaagcgataattcagtctctagttctccaatatttatgatactgcatgctgcagaaaagtcacagctccaaatacgttgaatctcatgacgcgatgcatgtcgaaggtccaagggcatgtggaaatggtcagttatattcaggcaattaaaaaacctaattat

SEQ ID NO: 564 - DNA, 2173 bp, Homo sapiens
cacttccccgatcgggccgtgtccgccgcggccctgcgaggtccgaggggcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggaaaatgacccagtcacagatatcatttgaggatgtggctgtggatttcacgctggaggaatggcagctacttaatcctactcagaagaacttgtacagagatgtgatgttggagaactatagcaatctggttttcttggaagtctggctagataatcccaaaatgtggctccgagataatcaagacaaccttaaaagtatggagagaggccataaatatgatgtttttggaaaaatatttaattcaagcataaacattgttcatgtaggactgcgatcccataaatgtggcacaggagaaaaaagtttgaaatgtccttttgatttgcttattccaaaaaataattgtgaaagaaagaaaattgatgaactcaataagaaattattgttctgtatcaaacctggcagaacccatggtgggataaaatactgtgattgcagtacatgtagaaaatccagcaacgaagagccatggctcactgctaatcacataacacacacaggagtctatttatgcatggaatgtggcagattttttttaacaagaagtcacaacttgttattcaccagagaactcatacaggagagaagccctatcaatgcagtgagtgtggaaaagccttttcacagaagtcactgctcacggttcatcaaagaactcactcaggagaaaaaccgcatgggtgcagcgaatgtcagaaagcttttagtaggaagtcactcctcattttacatcagagaattcatactggagagaagccgtatggatgcagtgaatgtggaaaagccttcagtaggaagtcgcagcttaaaagacatcagataacgcacacaatagagaaaccctacagttgcagtgagtgtgggaaagcattctcccagaaattaaaactcatcacacatcagagagcgcacacaggagagaaaccctatccatgtagtcactgtggaaaagccttcttttggaagtcgcagctgattactcatcagaggacccacacagggaagaaaccttacggatgtggtgagtgtcaaaaagccttcagcaggaactcacttctcattaggcatcagaggattcatacaggagagaagccctacgaatgcaacgaatgtggtgaagccttcatcagaaaaccacagctgattaaacatcagataactcacacaggttaaatatctgtggacaagaaacaggataatcagttactgagtgaagaaagacgggaatgatgtcccatactccccagctctctaaagtgttatgctgtacaattaaaatacccctgacccatcatctgctaccattcgttgtggataattcatgtaatctctaacctgtgggcaagtctttacccttcagtagtcaagattacgttagagacttcgtccacgaatccacaccacctttcccatcagttctcaccggaaatatgctgccaaaaagaaaatcagcttttctaagatcaagccagagttgcttctcttacaaccttacggcgctaatgcattaagttgaagtcgactgccaaagaggcccagcagagggcagcacccccatcatttttttgaatttctcccttaggaattttgccttcctttgtcttctgtccaccaggccttctctccagctggacacaaacctcctttgaagggaaataattgccgttaggcttcacagtagtgctttttcctttcacttggatttgcattttaacctgcatttcgaagatttttatacatgttttctatttccgacaatgccaggaggcttcattgacgttgtagtctgtgttaataaacttgtgtatcactctgctctgatcttttaggaattaacttgcaaatgaaatgaatatgttgggactttggcataatttgaatatagcattgtgtgagttgtgattgtctcttcctaattgtgctgtaataacctgtgtatgagaataaaatgatttccaccatc

SEQ ID NO: 565 - DNA, 1690 bp, Homo sapiens
gcgtcttgcaccaaagggaggtcgggatctcggttttccggccccgagagggaccaggtgcctccgccatagcttctgtcgctccatcgcccgcactgtgactggactgttagagggatccgtggagaggaggccaggacacctggaagccgggaaatggattcagtggtctttgaggatgtagatgtgaacttcacccaggaggagtgggctttgctggatccttcccagaagaatctctacagagatgtgatgcaggaaaccttcaggaacctggcttctgaaaaaaatggaaagatcagaaaattgaagatgagtacaaaaatcccaggagaaacctaagaggtcttatgggagagagactcttagaaagtaagaaagatcatcagcatggagaaattttgacccaggttccagatgacatgctgaagaagaaaactccccgagtaaaatcatgtggagaagtcagcgtgggtcatgcatcccttaataggcaccacagagctgacactggacacaagccatatgagtatcaggaatatggacagaagccatataaatgtacatactgtaagaaagccttcagtgatctcccctactttcgaacacatgaatgggctcacactggggggaaaccttatgattgtgaggaatgtggaaaaagctttatttcccgttcaagcattcgaagacacaggataatgcacagtggagatggaccctacaaatgtaacttttgtgggaaagccttgatgtgtctcagtttgtatcttatccacaaacgaactcacactggagagaaaccatatgaatgtaaacagtgtggtaaagcctttagtcattctggtagccttcgaatacatgaaagaactcacactggagagaagccttatgaatgcagtgagtgtgggaaagcattccatagttccacatgcctccatgcacataaaataactcacactggggagaagccgtatgaatgtaaacagtgtgggaaagcctttgtttctttcaattccgttcgatatcatgaaagaactcacactggagagaagccctatgaatgtaagcaatgtgggaaagccttcagatctgcctcgcaccttcgaacacatggaaggactcacactggagagaaaccctatgaatgtaaacaatgtggtaaagcctttggatgtgcctcgagcgttaaaatccatgaaaggactcacactggagaaaaaccctgtagctccaacacttcgaaaggccaaggcgagaagattgcttaattcacataagattcctagaagccaccgaatccaatcatggtaaaaatgtgtttccctcaaatcatgggaaccatcgcaaaattattctgaagcttctgcagtcactgtcatttgacagcattcagaaataaatgccagtagcccaggagcaaaaatttttgggagtagtttagctggggcctcactcagatacctaggacacagagttggaaataactcttaagagagacacacctccagtaagaccttaagacagttctgtcataaaaaaaatacgaggtttggccgggtgcagtggctcatgcctgtggtcccagcgctttgggaggccgaggcaggcggaccacgaggtcagtagttcgagaccagcctggtcaatatggtgaaaccccatctctactaaaaaaaaaaaaaaaaaa

SEQ ID NO: 566 - DNA, 2334 bp, Homo sapiens
gggctcggtgcgactgcgcagctcctcggcgcttcctcggtggcttccccgggtcgagcaaacaggtaagttcggggagacttcaggccagggcagtctcctgtcttctcctggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagattctgaggttgggaccaagaaggaactatctattttaaaccaaaaattttccgaagaagtaaaaaccccagaatttgtatcaagaagactcttaagggataatgcacaggccgctgagtttcgggaagcatggggccgtgagggcaaactcaaagagcgcgtgggaaattctgccgggcagagtttgaacaaacccaatattcacaagagagttttaacagaagctaccgtgggcagggaaagatctttgggagaaagaacccaagagtgtagtgcatttgatagaaacttgaatctggaccaaaatgttgttagacttcaaagaaataaagcaggagagagggtctttaaatgtgatatatgcagcaaaaccttcaaatataattcagacctaagtagacaccagagaagtcacactggggagaagccgtacgaatgtggccggtgtgggcgagcctttactcacagctcaaatcttgttctgcaccatcacattcacactggaaataaaccatttaaatgtgatgaatgtgggaaaacttttggactcaattctcacctccgtcttcatcggagaattcacactggagaaaaaccctttggctgtggtgagtgtgggaaggctttcagtcgaagctcaactcttattcaacatcggatcattcacacaggagagaaaccctacaagtgtaatgaatgtggaagaggctttagccagagcccccagttaactcagcatcagagaattcacactggagagaagccgcatgaatgcagtcactgtgggaaggccttcagtcgaagctccagccttattcagcatgagagaattcacactggagagaagccccataaatgcaatcagtgtgggaaggccttcagtcagagctcaagccttttcctccatcatcgggttcatactggagagaaaccctatgtatgtaatgaatgcggcagagcctttggttttaactctcatcttactgaacatgtaaggattcacacaggagaaaaaccctatgtttgtaatgagtgcggcaaagcctttcgtcggagttccactcttgttcagcatcgaagagttcacactggggagaagccctaccagtgcgttgaatgtgggaaagctttcagccagagctcccagctcaccctacatcagcgagttcacactggagagaagccctatgactgtggtgactgtgggaaggccttcagccggaggtcaaccctcattcagcatcagaaagttcacagcggagagactcgtaagtgcagaaaacatggtccagcctttgttcatggctccagcctcacagcagatggacagattcccactggagagaagcacggcagagcctttaaccatggtgcaaatctcattctgcgctggacagttcacactggtgagaaatcctttggatgtaatgaatatggaaaagctttcagtcccacctcacgacccactgaagatcagataatgcatgctggggaaaagccctataaatgtcaagaatgtggaaacgccttcagtggaaagtcaacccttattcaacatcaggtaactcacactggtcagaaaccatgtcattgcagtgtgtatgggaaagccttcagccagagttcacagctcacaccacctcagcagactcgtgttggagagaaacctgctttaaatgatggctctaaaagatactttattcatatcaagaagattttccaagaaagacatttttaatgtgataaatgcagaagacagtttagcaactgttcacttgacattagaagataagatggcataatgaaagatatataaggtctaaatattactggcaaagtaaaataaatagttcagatgactaaaaaaaaaacaaaaaaaaaaaaaaaaaaaaaaaaaaaaaaaaaaaaaaaaaaaa

SEQ ID NO: 567 - DNA, 3207 bp, Homo sapiens
ttcattgcttagtatcctctgctctagtagttcccggtgactgtcgcagcctctgttgccctctgacttgcagatgctgtgagatccagagctaagactccacgacatcccggaagccgaaaaatggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccagctatgtcttctcattacactgaagaccttttgccagaacagtgcatgcaagattcattccaaaaagtgatactgagaagatatggaagctgtggacttgaggatttacacttaaggaaggatggggaaaatgtgggtgagtgtaaggatcaaaaagaaatttataatggacttaaccaatgtttgtcaactctacctagcaaaattttcccatataataaatgtgtgaaagtctttagtaaatcatcaaatctaaatagagaaaacataagacatactacagagaaacttttcaaatgtatgcaatgtggcaaagtctttaaatctcactcaggcctttcttatcataagataattcacactgaagagaaactctgcatatgtgaggaatgtggcaaaacctttaagtggttctcataccttactaaacataagagaattcacactggagagaaaccatacaaatgtgaagaatgtggcaaagcttttaactggtgctcgagtcttactaaacataagagaatccatactggtgagaaaccctacaaatgtgaagaatgtggaaaagcctttcactggtgttcaccctttgttagacataagaaaattcatacaggagaaaaaccctatacatgtgaagactgtggcagagcgtttaaccggcactcacatctcaccaaacataagacaattcacactggaaagaaaccctacaaatgtaaagaatgtgggaaagcctttaaccactgctcactacttactatacatgagagaacccatacgggagagaaaccctataaatgtgaagaatgtggcaaagcttttaactcatcatcaattcttactgaacataaggtaattcatagcggagagaaaccctacaaatgtgaaaaatgtgacaaagtctttaagaggttctcataccttactaaacacaagagaattcacactggagagaaaccctacaaatgtgaagaatgtggcaaagcttttaactggtcctcaatccttactgaacataagagaattcatactggagagaaaccctacaactgtgaagaatgtggaaaagcctttaatcggtgctcacaccttactagacataagaaaattcatactgccgtcaaacgctataaatgtgaagaatgtggcaaagcttttaaacggtgctcacatcttaatgaacataagagagttcaaagaggagagaaatcctgcaagtataaaaaatgtggggaagcttttaatcactgctcaaaccttactacgtaagaatttttactaaagagaaatcctacaaatgtaaagaatgtggcaaattccataaatcttgctcaaggcattgaaatcacaagataattcatactggagagaaacactacaaatgtgaagaatgtggggaaagtcttcaaccattgctgacagcttattgcacagaagaaaattcatgctgagaaaaattctgattttaaagaatgtggcaaagcatttaataactactatgaacttactcatcagaggttttgtgctagataaaagcaatgtaagtgtaatgatacacattacatttatctgtggaaagatgtcaccaaataaaagccttagagtacacaaggtgtaatgatagtgatacattacatttgtacatggaaagacttcaaaaatataagccttagagtacacaagagtttttatactgaagaaaaacattacaaatataaagattgttgcaatacttttacttatgttacagattttgttgtacataggagaatttatactgaaaggtaaccctctaacagttgctcaaattttattccattttagataatttacattggaaagaaaccctacaactgtaatgaatatgaaaaaaattgtttaaaaagtacaccttagaaaacactagtttaaggccgggcgcggtggctcacacttataatcccagcactttgggaggccgaggcaggcggatcacgaggtcaggagatcgagaccacgatgaaaccctgtctctactaaaaatacaaaaaattagctgggcatgttgtcgggtgcctgtagtcccagctactgggagaggctgaggcaggagaatggcgtgaacccgagaggcggagcttgcagtgagccgagatcgcgccactgaactccaacctgggcgacagagactctgtctcaaaaaaaaagaaagaacgctagtttatatgaaagcatttaacagatgcagtaaatataaaaaattaataaaaaattaagtctaaatgaacatcagaagattcacagtagaaaccactaagacgctaacactttcaatgttattctaaatcagggcattgattataaagagtaattcaaggttaacataatttagttagcctaaacagaaataggagattaatattttgagacttaaacaattatattcaaagtacactttttgcattgaaagaattttagatttttacaaaggcaaattttgatgtaattgaactctcaaattacttgatgctgtgtctttattcctagtgtctgtatgaaagcatgtggtcaatttctgctgctcggggtttgagaagttctatattaggatgtcatttacatacttttcaacagaagattgaggacactgaaatatgaggtgtgtgaagaaagtacacagagaaacttttgtggttgacttataaaacttgtaagtgctgcatgagatagatgttcagagtaatagtcttgtgcattattcaaattttagtaaattgttttaccaattgcacattagatagtatagtggattttgtaatgcttttcttagactgtgtgaacttagtttcaataaaacaattatttttaatgtgttaa

SEQ ID NO: 568 - DNA, 3403 bp, Homo sapiens
tgatcaacaactgtcagctcccagtcagagagaaagggcctcttcagtctgtctcaggagactgggagaaacagcataaaggaccccacaaggaagggagaggtaccctgggtcaggcgcttgtggagagagggcttcgcatgtaaagtgacgtcagggaaaatagaacagaaaaaaagccagggccagcccagaggcacctgagaagaatcagacccacagctcagcccagccctggcacagagaagagacaggcctggcagcacccagggaccccctttcctcagcctccacctgcaggacagcaggagcactgatgcgctgaaggtacgttctggagtctggaagcagcagaactgaaggaagtaaacacgggtgtctgggaagacccctcaagctgcagtaaagcccaggactgaattggccacctgaggccaagggtggcactccaacctcctcctaaaggctggctagagccacaggaaagggccagaagccagagaaagggcaaaggtggacccctgcctccaaacctcctctggagactgacctcctctttcctgtgccttattgtttctccctcttctctttgttcgccactgggcggtgacctcagggatcctggcctaacctggtgattgtgcaggcaactgtgtccgagaagacccttctctggaagattgaaccccaattcagccatggtgactcctttgatgtcaaactggtaagggctgagccgtgggcacaggataccactccttccagctcttctgctgtgacctgcccatggaagtccctgtggacacgaaatcctgtttggatcatctaactggaggctctctgttcttcacctccacgcgccctcttgaccccaggaggttcaggggaggaagtacgccactctccactggcaccctccttggcctacacagagtcacccctgagcccctcaatgtgtgctgaggtgggccctgctctctgcaggggtatggagagaaatagcttggggtgctgtgaggccccgaagaagctgggcctgtccttctccatcgaggcgatcctaaagaggcctgccaggaggagtgatatggacagaccagaagggccaggtgaagagggccccggagaagctgcggcctcaggctctgggctagaaaagcctccaaaggaccagccccaggaaggaaggaagagcaagcggagggttcgtaccaccttcaccactgagcagctgcatgagctggagaagatcttccactttacccactacccagacgttcacatccgcagccagctggcagccaggatcaacctcccagaagctcgggtgcagatctggttccagaatcagcgagccaagtggcggaagcaggagaagattggcaacctgggggctccacagcagctgagtgaagccagtgtggtcctgcccacaaatctggatgtggctgggcccacgtggacatccactgctctgcgcaggctggctcctcccacgagctgttgtccatcggctcaagatcagctggcctctgcctggttccctgcctggatcaccctcctcccagcgcacccatgggaaacacagcctgtcccaggtcttcccatccatcaaacttgcatccctgtgctatgcatccttccacctccacaccccaaatggggcagcatctgtgctacttcaacatagagattggacatgctctccccaaatgagccactttcctctccaggtgaaggcaggtagcagatgtgccctgggcctctggggaaatcgatctcacaatccaaaaatggcccacagcccaggaagctaccctgaacatgccagttggaaggctgcaccagactcaaaagcaaactaaacaataaaggacagctctcttctctcctggctaaagctgctctcctggttcagaagacaggctggatgagatctcaggccgagctctgaaatagggaggtaatcctccagcacctgtgtttcctctaacttgctgtgtgacctccagccggtcactcaccctctctggacctcatctgtaagaggagccagctggataagatgatttctgaagacgcttccatggtgggcactgaggcacagaggaggccaaggagaggttgtttgttcatgcatgcattcatccgtgacacatgagtacctactgaggactccataaacagaacgggatacagagataaacaatttgggttctgtccacgtttgtcaaaaggtggtgctggcccacctctgaaagcagaacacttgctcaacaaccttgctgttggcccaagtctaacacattctttatgactgtgagcatctcagagtgagagaaaaatgtagaaagttttttaaattctaaacaggatttagtgtctttagttatcttgctggatgggaaagggatgttgtcatttctggcacaaatgaaaagtaggacggaaagctcctttcattcagtttatctttccaggatatatgaaaagggaccagctggaagactagcctcactctgtcctcgaaagcctgagctttcattcaactccctatttccatgcaaagacgctgggcaaaccacatgttctgtctgagcctcagttttcctatccataaaatgaaggtagccaggcctgcctcaaagagcattcaggaggctctgagaggacatgagagtattttgcaaagtgagggcaaggcccagtgtggagtgatattgttattccaagattccactgcaaaagtggctgctttggatgccagcccaggatgagtagttcctgttctcagggaggtcatccgctgagcatcccttctgcacagatgtctctgattcttgtccttgcaggtggaggacagggcctgctcccctaagctgggaagcctggaatgacctcttgcacaagcctaaattccaggaatcttccccaaatcccagatcctctgcaatctacctgcacccctgacccacccaggagttggaccgggagttgggaagcctaggtcttagtcctacactccttctaatttgctgtgtaaccttaccattaatctctctgggtctcagttttctcatctgtattggaggtagcagtgctagctctgccttcaggcatgcaatatgccagaactacagacaacagcccacaggatgcaaaagtgctttgccatcttaaaaatgccagatcactcagagcctatgaatgtggatatcaacaccaggtctctagcaccgctggatgaaaggagaaggctagaggctgagggaggaaagagcagttaacaaacaaaggcagtagctcatcacttgggtagcaggtacccattttaggaccctacactcaaatgtgcaaaataaaatttctatcattttgctataaaaaaaaaaaaaaaaaaaaa

SEQ ID NO: 569 - DNA, 1729 bp, Homo sapiens
ggagctgtgaagctgctggaggagttggcgtccggggagcaagggccatggccaccgtgcaggagaaggctgctgcgctgaacctctcggctctccacagccccgcgcacaggcctccgggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctgcaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcaggaagatgagtggctctcggcagcaattgactgttcagaataccttccagaccaaatggtggtggaaataagcagaagctttcctgagcaaccagaccgaacagacttagtgaaagaacttctgtttgatgccattggcagatattacagtagtagggaacctctgttaaatcacttatctgacgttcataatggaattgcagaactcttagtgaatgggaagacggaaatagctttagaagctacccagctccttctaaagcttttagatttccaaaatagagaagaatttagaagactactgtatttcatggctgttgcagcaaatccttctgagtttaaattacagaaagaaagtgacaaccgaatggttgtgaaaaggatattctcaaaagctattgttgacaataaaaatttatccaaaggcaaaacagatcttctggtactctttttaatggatcatcagaaagatgtttttaagattcctggaactctacataaaattgtaagtgttaagcttatggccatacagaacggaagagatccaaatagagatgcaggatatatttattgccagagaattgatcaacgtgactattccaacaatacagagaagacaaccaaagatgagctgttgaatttactaaaaactcttgatgaggattcaaaactttctgccaaagagaagaaaaaattgctaggtcaattctataagtgtcacccagacatctttattgagcattttggagactgagtttttaatatctgtatataagttgtgtattttaagaataaattatgtatcctaaatatccaatcacatttgtaagcgtggaagctctaaatttgaaactgtacttaataaaaatttttttgtataaaaaaaaaaaaaaaaaaaaa

SEQ ID NO: 570 - DNA, 4144 bp, Homo sapiens
gctgccattcggcaccggagtcgctccgcgctcccagaatgcaccggcagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttctttttgttttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtattttttaaagagctaaaaaaaaaaaaaaaaaa

SEQ ID NO: 571 - DNA, 5587 bp, Homo sapiens
gagtcggggataaacactccgcggcggtggcggctgctgctctgctccgggttctgtcactgtgtcggcggtgcccagctcactggccccctccctctcttgtcgagcgtggttgccagagaggctccctcagccctgctccgcggggtccacagcgggctccacagcgggctccatagcgggctccacagcggtccggcggcggcagcgagcccgtgggcagtgggggttggtcccgtggctccggcccccggtgcagaatggcggcggcggttcggatgaacatccagatgctgctggaggcggccgactatctggagcggcgggagagagaagctgaacatggttatgcctccatgttaccatacaataacaaggacagagatgccttaaaacggaggaacaaatccaaaaagaataacagcagtagcagatcaactcacaatgaaatggagaagaatagacgggctcatcttcgcttgtgcctggagaagttgaaggggctggtgccacttggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatccactagcttctctttttctcgccataaaaatttgtctctgagagactatacattccaatcaatttgaagcatccaagaattcttagaccgaataagcaatgtccacatctcagcaatccccctctttgctctcctcgtgtcctctcccagacctttcttccagttttctggcttactgtgttacttgcctaggaggaatgtccaagtgtgtcttgtacttaggaaactgaaggaaacaaacttttgaaattgagatcctgatctcagaactccaaagtaagctttgaaagcagcatttaagagcacttaaccatggacctcaccaccagtgaggaagtcaggaatacctctagaaaacacgcccttcacaccgcgcatgctcattcccccgacgcgccgcgtgtggatgggagcagtatttctcactttaaaatggacaccttgatagtgtgtctctggggttgcacagctcatcaaagttccaaattgtttgttctcacaaacaaaacggtacaatctatttttgtgcgatgttcttgggacctcgctgtgttctgctatctcgaggcacattctcccctccaactttgttaatgctacttgtctctggaacatttttttttcctacctcagagataaatgagatctccatttcccacttaacacagtgattatccttttttccccccccaaaatagtgacatttggtccaattataatctattttcctattgaactttcagcaataactgagctgtggcactagcagagctagtagccattatcagtgaaagaaaaagtccacatttctactctctgttgcaggtgaacaggagaggatggtacactgttactagaactcctctccttattgattatttttggacacacccagaaacttctttatggaggcttttgggttgatagtttaaaaggctgatttttctttttggttatgatttctcccttaagtggtctccgactttgtagcatttttatttaagctaaaacagagcacatgtatatgtacataagacacattaaatctataaatactatttattcattttatataaactaatgtaatggaaaacaaattcttatgactttgtggttttatagatgttctagaaactttgtatgtaggtatctacaaaattagttcattcccctgaatatttttgcattcatatttttgaggtcttgatgttttcagcctctggcgaatctttttcattgaatttgaaccatttgtaaaatctgtgatgctgaagcagagtgtgtcacaaagtgatgagaacattactaaaatccacggacgcactgcgacctaagggctcaacggctgactcggcagcgggcagccaccccacgctcccctgcggtcactcgcacaccacagcctgaagctcccccagcgcctgcacctcgcacacagctaaggtcaaagttcaaacgcactccacacggaagctcattctatacccgaagagcagtctcagaaagcaagattacttttgtgttttttaaaaaatgattctttaatgtatttttctaaacattctgattggaagtagtggattcctaaatgattccaaagtcacctgtaattcttctgtttttgttttgttctgtcttttcttcattttggctttgggtggggggaggggcaggtgacacaaaggattttttttttttttttttaatttttggaatcttttccaataaccagctaaagatttgcactgaaatacaacttgtatgccttttgcatttttaaagcctgcttcctggatttaagcagagtgatagtgttcaaagagccagttcagcctgtaacatatttgaaaaagatatgtctgcactttgaggtcccttttgaatgccattcactagacctctcaagcattttgtttcattgctacatccaagcgcctcacaagtccacaatgcgggacagcatcaaaagctcaagactttggaaaaagcttgtgggcttgcactgggggagggaagggaacaaaatttgtgtacttctttgtttaatttagaaataaggcatccaagagatgccattattttctgtgtttcaattgttgtgcctttgagttaaactgcatttttgtcttttggttgaaatctgaaatgtactgtcccaatataaaacagtaattatttgacctttgcactgtttgtctggtccttttcagtttgattgcatataaatgtggaacttgatagatctctatatttttaatgcacttgtgataaactggcagcagggttagacattactttcaaagcttgaggtagaccgagtcagcatgctagacaggcttctctctctaaccaaaactgtaatcttcaggaccagcaaactcagcccaaggcagctaatccccccaaccccatcctccgcgccccgtgcggctgatcggcagccctgattcgccaatttgtcctctctcattcactgatccaccagcctgactgctaagagctatagtctttttagttgttttgtctttttaagcaagatgaaaacctttctattagggattttggggttgggaggggatgggcagagatataaaccccagcctttaagactttgacaattgtacgtaaatacagatgtgtataaatataggcacatgcatatttttatgtgaaagttgattttaaaaaactaaaaaaatctaaactgcactcttattgataccatcataacgcaagtgggaaaaataagagtacgcagtctaatttaatttcatgcagtgggaaaatatatatgtgtgcttctgtaacatcctgaaaacatagctttccatcccctgttggctttgaatggtgggccgagcacccaggtcgtctgtattttggttttcttttgctaagcagagatcttgaattcttcaaggtgctgatagcaactgctggctcctttctgtagtcacacacctaatgctagtttagtgattcaaaatgcatcacatttttaggcaggacctagattttccctgtcaacctaagatgaaaataatttcagtgttgattcagaactgaacattaagtaggccctcgtcctgcagttggccacttgagtgttttgttttgtttttattttttaaggtgggcattttcctttaacctctactttttcaaaagcaacaaaggggcctcaacctgagtttcctatgggcctctcttctgcatccccaaagcggccaagagcaaatcctgggggataagaaaaaagtgtaaactaggtaggattgtgatgctcaaaataaccatctagcaatatcttggagcttgagaatagattttgtgggcttatttcttcttgcctcttccccatcctttcaagagagaacttatttttgaaaagtatctatatatacacacacacacacacacacacatattattatttaggtttttataccatactgtattggcgagaataccactatcattgtcctttacagtctatttcttcccccaagtcttggtctttttttattttctattttttcatgaaccacacaggagactttaacatcctggtcttttctgtttcttctttgtttccccaagtttgtctgtccccctttgccttccctgagtgttgaacatcaggtagtaaaaggctaaacgcaatttcttgcatgtcaatctattctttttctatgtttgactctgatgcagtgtgtttagcgtgtctagtagctggctactcctatttaaaaactcttcctggtagaagacaacccaaagacccttttcgatgaggtggtttctcattctacatcctctgatctctatagactgtaggatgctttgctttcaaagataactgggttagagggtggggtgtgcaataggtgatttatcatggtttttttcattatcaatattacatggatgattttctcagattcttctgaaagaagaaattgacaggcactgctagattcagctattgaatggctgaagagattgagtatttgaccttctctcaaaatcataaagtgagaattcataaggcacccaatgttaagatttatccagatttttacattttgatttcttctctctgtggggtggcaagttgagggagcattcttcattttagcttttacctgacaaccaaacttgcctttaccccatccctagaattggtgctcttggaatattgctgttaccatcatttttggggggccatcttcctaatgctacacacagcctgacaggggagcagcagatgaaagggtatgctattctgtttccagatgtttctttatgtaaatatgacgccaatgtaaatcctgtgtcaagatcatagagaatggtgctttttactacagttagcacatgcatttttagaaactactacatgttttagagaatctttgctgtgtatatgtaaactgtattgttcaactgttaacaaataataaattatttcattattaaagaaa

SEQ ID NO: 572 - DNA, 3056 bp, Homo sapiens
ggcagctgaggagtggaggctgggcagctccgactccctgacgccagcgcgaccagatcaatccaggctccaggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccacacggacgggcgcgccgccaacccggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaa

SEQ ID NO: 573 - DNA, 10384 bp, Homo sapiens
gcgcccgggccgccggccgggcccgggcctgggggcggggcgggaagacggcggccgggagtgttttcagttccgcctccaatcgcccattcccctcttcccctcccagccccctccatcccatcggaagaggaaggaacaaaaggtcccggaccccccggatctgacggggcgggacctggcgccaccttgcaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgtta

SEQ ID NO: 574 - DNA, 6256 bp, Homo sapiens
gcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctgaaaaaaaaaaaaaaaaaaaaaaaaa

SEQ ID NO: 575 - DNA, 8789 bp, Homo sapiens
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaaaaaaaaaaaaaaaaaaa

SEQ ID NO: 576 - DNA, 7012 bp, Homo sapiens
ccgggtcctgggcgagcgggcgccgtgcgcgtgtcccgcggccgagctgctaataaagttgcagcgaggagaagcgcagcgacggcgtcgggagagcgcgcctagccggctcgcgaaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaaaccattttagcaaattatggttatatgttttaatttaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcaacaaaaagatattgattggcaaaaagcaagatataagagattcatttgcttaacatttctacataatatttatggtctggtcagtattggtctggtcagtattgcctggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccacttaaaatatataaatatcctttttacttcatgaggaaggaagaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacctgc

SEQ ID NO: 577 - DNA, 2886 bp, Homo sapiens
cgatcgagggagctgagccgagagaaagagccgccgggcgctgcctcgccagacctcgctgggaccccggggccaccgggaggcacttttgtggaggggggagggggggcgacctcggcagcctcggcgcacgaagcgtccgagggcagcgtggggcgggctgcgacctctgcatcggtggactgcatttttaattaaggattcccagcagctctttgggatttttacagcttccactcatgtgttgacacccgcgtccaggagaaactcgctccaagtgcatctagcgcctgggacctgagacggcgttggcctttcgtgcatgcaaatccagggatttaggttttgtttgggatttccttttctttctttccttttttttttctttttgcagggagtaagaagggagctgggggtatcaacaagcctgcctttcggatcctgcgggaaaagcccatgtagttaagcgctttggtttaaaaaaaaggcaaggtaaaggcagggctttccagacacatttaggggttcgcgcgagcgctttgtgctcatggaccagccgcacaacttttgaaggctcgccggcccatgtggggtctttctggcggcgcgccgcctgcagcccccctaaagcgcgggggctggagttgttgagcagccccgccgctgtggtccatgtagccgctggccgcgcgcggactgcggctcggcgtgcgcgtgttcccggccgtcccgcctcggcgagctccctcatgttgtcgccctgcggcgccccttcgacgacaggctgtgcgcggtctgcacggcgctccgcggcggagcttcatgtggggctgcgacccgcgcagccggcgcctcgctgagggaacggacccccggtaaccggagaccgcctcccccccacccctggcgccaaaggatatcgtatgttcaggtccaaacgctcggggctggtgcggcgactttggcgaagtcgtgtggtccccgaccgggaggaaggcggcagcggcggcggcggtggcggcgacgaggatgggagcttgggcagccgagctgagccggccccgcgggcaagagagggcggaggctgcggccgctccgaagtccgcccggtagccccgcggcggccccgggacgcagtgggacagcgaggcgcccagggcgcggggaggcgccggcgcgcagggggccccccgaggcccatgtcggagccaggggccggcgctgggagctccctgctggacgtggcggagccgggaggcccgggctggctgcccgagagtgactgcgagacggtgacctgctgtctcttttcggagcgggacgccgccggcgcgccccgggacgccagcgaccccctggccggggcggccctggagccggcgggcggcgggcggagtcgcgaagcgcgctcgcggctgctgctgctggagcaggaactcaaaaccgtcacgtactcgctgctgaagcggctcaaggagcgctcgctggacacgctgctggaggcggtggagtcccgcggcggcgtgccgggcggctgcgtgctggtgccgcgcgccgacctccgcctgggcggccagcccgcgccgccgcagctgctgctcggccgcctctttcgctggcccgacctgcagcacgccgtggagctgaagcccctgtgcggctgccacagcttcgccgccgccgccgacggccctaccgtgtgctgcaacccctaccacttcagccggctctgcgggcccgaatctccgccacctccctactctcggctgtctcctcgcgacgagtacaagccactggatctgtccgattccacattgtcttacactgaaacggaggctaccaactccctcatcactgctccgggtgaattctcagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagttttatatattatatggaaatatatattatacttgtaattatggagtcatttttacaatgtaattatttatgtatggtgcaatgtgtgtatatggacaaaacaagaaagacgcactttggcttataattctttcaatacagatatattttctttctcttcctccttcctcttccttactttttatatatatatataaagaaaatgatacagcagagctaggtggaaaagcctgggtttggtgtatggtttttgagatattaatgcccagacaaaaagctaataccagtcactcgataataaagtattcgcattatagttttttttaaaaaaaaaa

SEQ ID NO: 578 - DNA, 3103 bp, Homo sapiens
cggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggtcagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgttttttcctatgggtgttatcacctagctgaatgtttttctaaaggagtttatgttccattaaacgatttttaaaatgtacacttgaaaaaaaaaaaaaaaaa

SEQ ID NO: 579 - DNA, 5481 bp, Homo sapiens
cgcactaatacgggcgatgaggcttcgcggctccagtctgactgacgccggctggggccgccgccgccgccgccgccgccgccgctgctgcagccgctgtctcggtccccgccgccgccgccgggccctgcaggcgctgggcgcgcgcagccaggcaagttggccaccctgttcaagggcttaggagaaagtcaacacacttcgcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaacccctacagtttaaatgatgtcacttttagtgctgttggcaagaaaaaaaaaacaacaaacttgtacaatgaattaatgagataggccatagaaactttatttctaaggttgacatacctatagctgggctcctgtgctcatattcagtggtacattttaaacaaactgtgatcggaaaagaaaaaaaactgtgaagccaaaagtcatgttccctcagtctaccactgtaaaaacagagtctaatatgggaaaataaatatgaaaatagcatgaaatgctgtttcccagattgcaagataagaccagaacttggtccaagagccagccacccagggagactcctgctttccacagaggagaccaggttcctgtcgtgctggttgttcgtgtcaggcagtcctgcaaactttgagtctgcgcagcgtgccagaatagcttgtgtttcagtcctgtgtcaagaagcaggtgaaaccaaaggttggagaaaagcatcacacgtcgacttacactttctcatttcccacgttccagtctcctgggaagggcactctttcgccacgttttcctgcctcttggcaaatattaactctttgcagatcactaaagcaacagtaaagactttgagaaaatctagacacattattggatcaatgagttatttaacctagtgtctagtgattatctaacctggaaataaattcccaaggaaagtgataataatttcataatcatctgcaatttctggggaacagtggtactgaataataagacatcttttaaaaatatacacaatattaaaaacctgttcttattttactttagatgagggaggaaaatcccccaaatttctaggtactttcatatatatacttgccatgcactaaacactgcattgcttggaaaaatatttcacaccctctttaaaaatgtacaatttaagatggcagttatgcttgtaacagacagcacttcagtaatccaagaagtttcttcatttatacattttatctcaactctttctagcattagtgcacatggtagtttttctaattaaattgtattcaaggtagaaatgatcatgtgagaaagatatatgattgagctactactgtcacctcttacagttactagtgttagctaatagaaactttcatatatacacatagaaaagaattattacattttacattgaaaaatgtaatatatggcccatgtagtgtatagaaaaatctgtagtttattggttcatcaactatgtattgtgcacctacctatgggtgtcaggtacaatgttaggtactgtagaatcaaatgtaaataagagacagtcccagccctcagggagccgagaacctaatagtgaatctgtttgtacagacatcttcatgtttcagaacttttaaaacaaaacaaaataatgtaatctatcatcttttgcttgaaagaatgtgattgatttcttatctctgttttgaaattatttccttactcttctgcaaagtcaggtaatggattccttgtataaatgctacttttcttccatgtctcaaagttgttttttttcctcccctttcttccctgttttccaataattctccatgtccccttttcttagaaaaggcattaatatggtgaatcttgtatgggaaccattccatgggagaacttcaacacagtttttgctccagagatcaaacatagctttcgtgatctctctaccagctatctaacttatcctctggtaatctttttttttttttttttttttttgagatggagtctcgctgtgtcaccaggccagagtgcagtggcgtgatcttggctcactgcaacctctgcctcccgggttcgagtgattctcctgcctcagcctcccaagtagttgggactacaggctaccacgcccagctaatttttatatttttagtagagacggggtttcaccatggtagccagaatggtctctatctcttgaccttgtgatccgcccgcctcagcctcccaaagtgctgggattacaggcgtgagccactgcgcccggcttcctctggtaatcttacacctttacagaattaatctaaactggtggctcataaatgacattaaaaacaaaaaaaaaatctggatgcagtggctcattcctatagtcccagcactttgggaggccaaggcgggaggatcatctgagcccaggagtttggggctgtagtgaactatgatcatacaacttcattctagcctgggtgacaaagtgacaccctgtctctaaacaaaaatcaagaaacaaaaaacttgtatttccctgcagctttgggaagccagaacacaatattgcagtgaatctgaattttctgtgacaaataaattattaaattggcacatatgatcatcaccagtcatgtctcatcaaaagcctttattatgatgcttgtacattttgaagaatttagaattaatgagaagttaaccctttagtcattgtaacacaatcatattttaatcagctttttcttttgctaccaagagtttcaaaaaataaatgcagtatttgatttcaggctgctaaatgggctcatttagcattcattccttgatgtagacattaaaaaaaaaactgaatagcattctttccaggataactaataaagcagacatgctaagcctataaatacatcagcactgcagcacacgtttaaggttgccacggacaaggatcacacaatagagaacactgtagtaacatttcggtctgctcacaagacccagaacattgatcagtttttgttgttggtttattatttttctgttaaaaaattgtgaaaagtttgttttagctagatgatattttaatagctgcgagtgctttggaactataaagatgtcactacttaacacatataccttatgttttgttttgttttgttttacactcagtataaatcaggagaagttagccaaccatctagcatttagaatcctcttttttattgtcttctaaggatatggatgttcccataacagcaacaaaacagcaacaaaaacatttcataaatatcacttgatagactgtaagcacctgcttaactttgtgtcccaaatatttagtgtgtatatatatatatatatatacacacacacacacatatatattcaacaaataaagcaaaatataacatgcatttcacattttgtctttccctgttacgattttaatagcagaactgtatgacaagtttaggtgatcctagcatatgttaaattcaaattaatgtaaaacagattaacaacaacaaagaaactgtctatttgagtgaagtcatgctttctattataataacttggcttcggttatccatcaaatgcacacttatactgttatctgattgtttataataaagaatactgtacttata

SEQ ID NO: 580 - DNA, 2656 bp, Homo sapiens
gaggctttaaaatcttttttcatcttctagctgtagctcgggctgcttgtcggcttggcctccccctcccccctttgctctctgcctcgtctttccccaggacttcgctattttgcttttttaaaaaaaggcaagaaagaactaaactcccccctccctctcctccagtcgggctgcacctctgccttgcactttgcacagaggtagagagcgcgcgagggagagagaggaaagaaaaaaaataataaagagagccaagcagaagaggaggcgagaagcatgaagtgttaactcccccgtgccaaggcccgcgccgcccggacagacgcccgccgcgcctccagccccgagcggacgccgcgcgcgccctgcctgcagcccgggccggcgaggcgagcccttccttatgcaaagcgcgcagcggagcggcgagcgggggacgccgcgcaccgggccgggctcctccagcttcgccgccgcagccaccaccgccgccaccgcagctcgcggaggatcttcccgagcctgaagccgccggctcggcgcgcaaggaggcgagcgagcaaggaggggccggggcgagcgagggagcacattggcgtgagcaggggggagggagggcgggcgcggggggcgcgggcagggcgggggggtgtgtgtgtgagcgcgctcggaggtttcgggccagccaccgccgcgcaagctagaagcgccccagcccggcaagctggctcacccgctggccacccagcacagcccgctggcccctctcctgcagcccatctggcggagcggcggcggcggcggcggcggcggcaggagaatggcatcagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcagctcggtgcccccttcccccagcttctcggcgcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggcttcgatggctacgcgcgcggggcgcagcagctggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcagcgcggccgcctcggccggtggcgctgggggcgcgggcggcggtggcccggccagcgctgggggcggcggcggcggcggcggcggcggaggcggcgggggcgcggcgggggcggggggcgccctgcacccgcaccacgccgccggcggcctgcacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcataactgagcccactcgcaagttggagccatcagtgggatacgccacattttggaagccccagcatcgtgtacttaccagtgtgttcacaaaatgaaatttgtgtgagagctgtacattaaaaaaaatcatcattattattattatttgcagtcatggagaaccacctacccctgacttctgtttagtctcctttttaaataaaaattactgtgttagagaagaaggctattaaatgtagtagttaactatgcctcttgtctgggggtttcatagagaccggtaggaaagcgcactcctgcttttcgatttatggtgtgtgcaagtaaacaggtgcattgctttcaacctgccatactagttttaaaaattcactgaaattacaaagatacatatatatgcatatatataatggaaagtttcccggaatgcaacaattagcattttaaaatcatatataggcatgcacattctaaatagtactttttcatgcttcattgtttctctggcagataattttactaagaagaaaaatagatattcgactccccttccctaaacaaatccacgggcagaggctccagcggagccgagccccctggttttctcgtaggccctagacggtgttgcatttatcagtgatgtcaaacgtgctcatttgtcagacatagctgtaaatgaaaacaatgtgtggcaaaatacaaagttaaaaaaaaaa

SEQ ID NO: 581 - DNA, 3378 bp, Homo sapiens
acagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgctgcgccctcgctccccgcctccccagctcttctccgctcttcccccccgcgcttggctcggcgcgctccggccggccgcaaagtttcccgggcggcagcggcggctgcgcctcgcttcagcgatggccgcggagctgagcatggggccagagctgcccaccagcccgctggccatggagtatgtcaacgacttcgacctgctcaagttcgacgtgaagaaggagccactggggcgcgcggagcgtccgggcaggccctgcacacgcctgcagccagccggctcggtgtcctccacaccgctcagcactccgtgtagctccgtgccctcgtcgcccagcttcagcccgaccgaacagaagacacacctcgaggatctgtactggatggcgagcaactaccagcagatgaaccccgaggcgctcaacctgacgcccgaggacgcggtggaagcgctcatcggctcgcacccagtgccacagccgctgcaaagcttcgacagctttcgcggcgctcaccaccaccaccatcaccaccaccctcacccgcaccacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcgacagcccctcctctcccgagttctttctgtgagtcgtggccggtcctggcccccgcccttgccccggcccggactccctgtcccacgtccctagtcccagactaccccggaccctgtccctgccgcggccccagccttgacctgtttgacttgagcgagagggaggaagggcgcgcgggccgcgggcgacgggcgggtgcgcgggcgggcaggggaccttggctaaggcgagagtagcgcacgccagcgccgcctcctagactcgagcagagccggagagagagacgagagggtgggaggtcccggagtaacttctctccaggctgaagggcggcgaggcatagtcccgagaagtcaccaaggccatctggagactcctggctttctgaactttgcgcgttaagccgggacagctgctttgctgcccggagagtagtccgcgccaggaagagagcaacgaggaaaggagagggactctggcgtcccggcaggcgagaggcgaggctgagcgaaagaaggaaggacagacggacctgtctgtcagagttcggagaacactggctctcagccctgagacacaggcctcagttaggacgctcggcgcccaaatctcatcagttttattgcctgctcgattatatagaaaaatacaaaaaatctgcattaaaaatattaatcctgcatgctggacatgtatggtaataatttctattttgtaccattttcttgtttaactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttgtaagttaaaaagaaaaaaaaaaagaaaaagttccgggcattttgcatcagaaaacaactttgtcttggggcacacttggaagttgcatgttttctttccttcccttatccccattcggtcctctttttcctctctcgctttagttttcaaccttgttggtgctgagagagagaaccgagaggtcccagtacaagggcagggcagggcagggaagctgccaagctccgcaccccagaggagtgttctggactacagccttgtcttatggtcaaattgatacccttaataagaaaggaaaggaaaggaaaacagatcctcccctctgctttttattgtaaccagaatcaccctgaggtcccttctgaaccctctgggcctgcgctaattgtaggagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagtaggaagagttcttggtggtgtccccccccttcaattcttcagttgtatagtagttatagggaagatatgggtgtttttctttattattacttttttttttctgcaggtcagtaaaaggatttaagttgcactgacaaaaataccaaaataaaagtgtatttttaagttcccatttgaaattgctggcgctgctggccggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattcagactggtttctgttttttggttattaaaatggtttcctattttgcttattaaaaaaaaaaaaaaaaaaaa

SEQ ID NO: 582 - DNA, 2450 bp, Homo sapiens
cgggtcggtgacgtcaccgcatgactgggtttttatgaatgaaaggaatcctgtgagtgagtaattccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcgggtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacagagaataaaaaaaaaaaaa

SEQ ID NO: 583 - DNA, 5043 bp, Homo sapiens
cggcggcggcggatcccgagcctggtccggcccggccttcccagtgcgctcggcccggcccgcgcaggcggcgagtcctccgagccccgggcccggacccctcgcgccggtccctgccccgcgcggcctcggagcgcgcgcggccccgccccgccccggcctcggcccgccgggcccgcagtgtgagagcgcctgctcgctgtgcccccgggttatgacgacccccaataaaggaaacaaggccttgaaggtgaagcgggagccgggtgagaatggcaccagcctgacggatgaggagctggtgaccatgtcggtgcgggagctgaaccagcacctgcggggcctgtccaaggaggagatcgtccagctgaagcagcgccggcgcacgctcaagaaccgcggctacgctgccagctgccgcgtgaagcgggtgacgcagaaggaggagctggagaagcagaaggcggagctgcagcaggaggtggagaagctggcctcagagaacgccagcatgaagctggagctcgacgcgctgcgctccaagtacgaggcgctgcagaccttcgcccggacggtggcccgcagccccgtggcgccagcccggggcccccttgccgccggcctggggcccctcgtcccaggcaaggtggccgccaccagcgtcatcacaatagtaaagtccaagacggatgcccgatcgtagggacgcgcgtctgcccaggcgggtctttgcggggccactaggcacatggcgaatttggctgccctgtccctctgtttccttctcttctctttcctccctctcttccccacccttctctcttccctgcaaagcacaacctgtaccccaggggcgccgggctgagcccctttgatctcgtcattgtcgtcgtgtgttttgtatgttgggattggtcagttcggcggtgacgtggggtcgccccaaccccttttgtaccagggccatgcaggcttggagtccagagttggtgctgtgggaacggactagagagagttgcgggagagagaaggagcaggcacgctgggcctcgcgtgtccccgagcagtgagggtcccagtgttccctccactcccgagtggccacaggctcgcgggctgggaaggattcactctctttagccccaggggagcagctcagcttagcccagcatgaagagatgggctctgctctgagagtagggcgggcttgaaggccctgatgggtggaccaccagcctgggcgcagtggtgctgggggcgtgcagctgggcccaggggctgtgcactcaggcctgacccgttgcactgaacaagaccaaatcgctggttgtgcgcttaacgtgagggtgggtccagtgtgccctgcgatgggtcccgtgtcactgtttacatgacctatttgtgtggttatatagccctttatttaaaagagagaagttccttttacaaagttattaaattaattatatgtttaaaagttaaagaaaaaagagctgcagagtatttataaaactgtcttttagaaaaaaaacaagcaagaagaccatttgaccatatgaatggaaaagggaagaaagtataatagaaactttgctagttaaaaaaaaaagaaaaaaaaagaaaaaaaatccctttcttgtaaacttacggacacctctttgtggctgttggagtttagtttttatatacacagagttatcagacattatttataaaacttagtttaaaaaaaagacaaaaaaaaaaaagccaagccgtgagccgaccagaaggccgtcctctttgatatcttttgcaattgtaccgaaagtgacttactcctctgcccttcctgcttccgtctcttgccggtgccgtggtgtcgtccgtgcctggtgaggttttgtgcagcggtaaagtgctggtgcttctggtgacctttgacctgtgggtgtcacttcttgtgtctgttttcccgtgttcgttttttgggtttagttgtgcttttgcttctgctggcttgctggacctgggctggggtgccaagtggcgcctgctgcgtcagagctcaaggaatctgtgcccaccaccagctcctggtccgtaggaggtgagacatggggttctgtcatgcccccctccactgagccttggctacatctgtgtctagggcttgggctgatctagtggcggggtaggtgaaactggggtcccttggggcgccccacgctgcttccacacccaccacctctggccttgggtggtggcattacagggatgagggagtcactgtgggtggccacagggctatggccaagcgttccctggccgtcttcctctggcctcagctttgttcctataggctgcccgcgccgtgggctgcaggtctcgccgcccgcttgatccctgaggtgtttccatgctgcgggtggtgcttccaggcagagtgggtgggggcccaccgggcaccgccctttcttccttgtccctgcctcactctgagagccttgggggtctccaccagtgcagacaagggctacagtctccagggccgggtcttgtccctcttctccgctggtccacgctggcagctcttggcttcgggcctgccttctgcctccctttgggatctgtgtcttccagggatcagctgcttggcttctgctggaggtgcctccctgtgggggcgcagcctgcctcctgctctcagttcctcgccagaggctgctgcccttcctggctgggctcaggaggctccttgtaggcatatgatggggagggggtgcccctacccacctccaagaggctacagccctgtgtctggccatgtgagccctggcctttcaccgggttgctggtttcttttctgtggggcccagacttctgtaaagcacacagatgtgggtaagatgaaaaactgtggcccaacagggcttaaccctatggatggtgggatttttatccaatagtttggcctggtgtgcccacaggatgggaacagggaggcaccatcaacacttgtcatgttaatgagcttttctttgctcgaggtgttcagagacaagtcctgtgtctacctgcgtcagcctgaaaatggaaatattggctgttgactcttgtcatttagtgacttcatccccctcccctcagtctgatcttgtctaagtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtggtggtctcttctcacctcagtttttctgacacagcgaatcgagggctttggccaaggccaggtctctcaaacttgtccgccaagtaaaccatgatatatgtcttcccttccaccttaactttgccccaactcctcttttatcctaacatggacgctcagatttcagaggaatacccagcagggacaggtcagctctcaccaggagagtgaggcccctggctgctgctcggggtggcactggtgttgctggctcagctcttggtgcatgtttcagatatgtgtgtacacttctgactggtgatcagggcccggcccacggccctgagcggctgcagcctgctttgggacgatggtcaggtcccatgttgtccctgctgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgtgagacctccctgttcttggtgaccccagttgggctttggcccctccagcaaccttgtgtcccagccctgcccttcttcccaccccctcaatctgctagtccctgaagcctttaaccaaacgggagtgggcacagaaagccttctcctggcaacaggacaagggctgcccgcgtgtccagccctgttgctctcctggcgctgagaggtgggtccaagcagagttgatcagtccctgcctgccctgcctaggtctagccaggggaggttgtgtgtgtgggagaagaccccgggatctgctggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcactgggcctggccccccgggtatttattgctgtacatagtgtatgtttgtgatatataaggttttctttattttgtatatgatcaataaaccttttaaagagaaaaaa

SEQ ID NO: 584 - DNA, 2470 bp, Homo sapiens
ggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggtgagaaaatatttcaagaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatccaaaaaaaatacggcttttccaatgatgaaatataatcagaagatgaaaaatagttttaaactatcaataatacaaagcaaatttctatcagccttgctaaagctaggggcccactaaatatttttatcggctaggcgtggtggtgcatgcctgtaatctcggaaggctgaggcaggaggatcatttgagctcatgagggcccaggaggtcaaggcttcagtgagccatgatcatgccactgcactccagtctggatgacagagagagaccctgtctcaaaaaatatatatttaaaaaataaaaataaaagctgaccccaaagac

SEQ ID NO: 585 - DNA, 4748 bp, Homo sapiens
agcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagccgcggccgcggccacagtcatgactcagtcgactgccaaagcaatgaagcgacctctcgaagcaactgtagacctggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagggtcagttttgtgcatgacacccgctaccagtattgtacccatgatgcacagcgctacgtccgccactgtctctgcagcaacaactcctgcaacaagtgtccccttcgcagcaacagccacagccaatcagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatatttttgtagattaattgttgtaacattgtctttcttttttttcttttgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaaggaaaaaaaaaaaaaaaaaaaaaaaaaaaa

SEQ ID NO: 586 - DNA, 877 bp, Homo sapiens
gcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaactggagtggcagggtcccagccagtgagtgagaagcagtcggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacctaaaaaaaaaaaaaaaaaaaaa

SEQ ID NO: 587 - DNA, 5533 bp, Homo sapiens
gattgccatctgacaagatctccaaatcaaagtgataaatcgctccaaactttttttggcggcgctgagatgttggaggggcgtctagcgcgcatgtgcgaaggtgtccaaactgacaatgctggagagatagcgagtgtggattgagagaaagggagagagggagggagagagagtgaaagaagaaaatacagagagtgagtgtgtggaagagagagagaaacaggagagaaacaggagggagggagagagagagagagagagagagagagagagagagagagagagagagagagagagacaggagagagagggagggagcgagagggagagcaaaagaaggaaaggatccaagaaaaaaaagccccaaccacacaccagcggctgcaggactgggcacagcatgagatccaaaggcagggcaaggaaactggccacaaataatgagtgtgtatatggcaactaccctgaaatacctttggaagaaatgccagatgcagatggagtagccagcactccctccctcaatattcaagagccatgctctcctgccacatccagtgaagcattcactccaaaggagggttctccttacaaagcccccatctacatccctgatgatatccccattcctgctgagtttgaacttcgagagtcaaatatgcctggggcaggactaggaatatggaccaaaaggaagatcgaagtaggtgaaaagtttgggccttatgtgggagagcagaggtcaaacctgaaagaccccagttatggatgggagatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagtattttt

SEQ ID NO: 588 - DNA, 10241 bp, Homo sapiens
ccggcgtcggcggcgcgcgcgctccctcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccgtcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaattt

SEQ ID NO: 589 - DNA, 1344 bp, Homo sapiens
gaaagagaacctgtaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaagaagaaaagatattattcccatcatgatttcttgtgaatatttgttatatgtcttctgtaacctttcctctcccggacttgagcaacctacacactcacatgtttactggtagatatgtttaaaagcaaaataaaggtatttgtata

SEQ ID NO: 590 - DNA, 5569 bp, Homo sapiens
agaacgagttccggtctggccgaggcttgtctcctaaaaatagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactaaatacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttgtaaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttcccccccccccaccccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagaggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttttatcaaatggtgaagacaatgctaaaaaaaaaaaaaaaaa

SEQ ID NO: 591 - DNA, 1978 bp, Homo sapiens
gtacgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaaaaaaaaaaaaaaaaaaaaaaa

SEQ ID NO: 592 - DNA, 6458 bp, Homo sapiens
gcgatgtttcaaacgctgtgagctgttctccttttcccattcgtcttctgtcacttccttcctggacgcagttttctggacgagtctggttacttttaatccgaccggccgctgagagccactttctcctcctcctcctcctcctccttctcttcctcctccttcttcctcctcctcctcctcttccgagcggcctcggcgcgcgcgaatgcgcggccccgcgccccccccctcgcgcgcgctcccctcgcgcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtga

SEQ ID NO: 593 - DNA, 5888 bp, Homo sapiens
atatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaatggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagtcgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgataaaaaaaaaaaaaaa

SEQ ID NO: 594 - DNA, 3507 bp, Homo sapiens
gaagccagacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcaggaatattccacacaagaaaacggcacagatgattccgcagcgtccagctccctgggggagaacaagcccaggagcctgaagactccagaccaccccgaggggaacgaggggaacggccctcggccgtacgggggcggagctgccagcctgcggtgcagccagcccgaggccgggagggggctgtcgaggaagcccctgagcaaacgcagagagaaggcctcggagggcctggacgcgcagggcaagcctcggacccggagcccggccctgccgggcgggagaagccccggcccctgcagggcgctagaggggggccaggccgaggtccggctgcgcagaaacgccagctccgcggggaggctgcaggggctggcggggggcgccccggggcagaaggagtgcaggcccttcgaagtgtacctgccctcgggaaagatgcgacctagaagccttgaggtcaccatttctacaggggagaaggcgcccgcaaatccagaaattctcctgactctagaggaaaagacagctgcgaatctggactcggcaacagaaccccgggcaaggcccactccggatggaggggcatctgcggacctgaaggaaggccctggaaatccagaacattcggtcaccggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgttccagagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactgaatgcccaacactgcatctctcttcctgcttctggccttgtatcttgcattcacactcaatagtcacggaatgccgactaggtgctagctgctatgggaaatgcaaaaataacaaaatagttactgtgcccacggagcctacccgattatagcagaggtaagttaggaacgaacatgttagtcaatccgggtgaagacatgtactgatgacacaccatggatttcagaggaggaagtacggagtcgttgcataatccgcccctggtgggtggcactctcaggtgctcctgaacagaagatttggccctcattttccctcagaaccccacggcaaggatatatgtccccttgttctctctgcttctgtcttgaggatatgggaagcctagagaaacgcaagcagactggattgggatagaagtatttgtgtacctggattaatgaactatgattttttttttttttttttgagaccaaatcttgctctgtggcccaggctggagtgcagtggcacgatctcagctcactgcaacctccacctcccaggttcaagcgattctcctgcctcagcctcctgagcagctgggattacaggtgcgtgccaccacaccaggctggttttcttgtatttttagtagagacgggggtttcaccatgttagccaggctggtctcgaactcctgacctcaggtgatccacccgcctcagcctcccaaagtgctgggattacaggcatgagccactgtgcccggcctatgattcttttttttttttttttttgagacaaagttttgctcttgtcacccaggctggagtgcagtggtgcaatcttggctcgcaacctccgcctcccaggttcaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgccgggccatgattcttaagagaattgactgggcctcatgaataaaaaaattagaaaatctaaaaaaaa

SEQ ID NO: 595 - DNA, 3198 bp, Homo sapiens
atttgaggtgttctgaccagaagaagacagagcggatgatcattcattcaccacgttgacaacctcgcctgtgattgacagctggagtggcagaaagccatgagatttggtagttgggtctgaggggcgctcttttttttccttttctttctttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtcaaaaaaaaaaaaaaaaaa

SEQ ID NO: 596 - DNA, 3623 bp, Homo sapiens
tcccgctccccactcccgggatgtgtctccgccgtacgacgggctatggccaccacgacttccgggttccgtcatttcgttctcccgccgccgacccgcgccgccaaactgaggctcttcaataagccaggcagcagccaacctgccaacacctactgacactcactcatctcccagagagagaaagagagcgagagagagcgagcgcgagagagcgagcgcgagtgagagcgagcgagcgagcgagaaagagagagagggagagacaaaatacctaccaggaaagggggggaggaagtccaatttttgcaaactattcatttttttttcttgatttttctcactgctttctttgaacaatactttaaagagagaggatcgtattatagataccgcgggggcaaagctaaaaaaggggggaggggggaggaaaaaattcaagaagcagaaacccctcgcggagttttactggaagaaaaaaacgggtctgaaagattcctcctcttcatcatcatcaaccatcattcattcactaccttgacattccgggctttgattgacagctggagtggcaaaaagccatgaaacacgacagttcggttacatgtgggctgctgacgggccgctcgtaaccttcagttcgggggcttgacaatttttttcttctttttcttctttttcttttctttctttttttttccaactgaggggaagagaagagaaagagggggaaaggaggaccgaagaggaggaggaggggaggggggaggaggaggaggtggaggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacagtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgaaaaaaaaaaaaa

SEQ ID NO: 597 - DNA, 1668 bp, Homo sapiens
gcggccgcccatcgacctggtcatcgaggatcgggatggcggctgcagggaggacttcgaggactacccagcctcctgccccagcctcccagaccagaataatatatggattcgagaccatgaggatagcgggtctgtacatttggggaccccaggtccatccagcggggggctggcctcccagagtggggacaactccagtgaccaaggagtcgggctggacaccagcgtggcctctcccagttctggtggagaagatgaggacttggaccaggagccacggcgaaacaagaagagggggatcttccccaaggtggccaccaacatcatgcgagcctggttgttccagcacctctcacacccgtacccctcggaggagcagaagaaacagctggcgcaggacacggggcttaccatcctgcaagtcaacaactggttcattaatgcccggagacgcatcgtgcaacctatgatcgatcaatccaaccgcacagggcagggtgcagccttcagcccagagggccagcccatcgggggctataccgagacagagccacacgtggccttccgggctccagcatcagtgggggatgagtttggaactcggaaggaggaatggcattatctatagaggctgatgcgggagagacccagcctccggctgtgacccccagcctcacacctggctctggttcccgcctggtcctctggcttcaggatcccacctccaaaggcctctccgctcaacgcctacctccctagggccctgctgggacatgggggcctgagtgcccacccaaggggctctcaaggacaccggcaaggcctccaggctctgagccccgcttctgccttcacctctgcctgggacccgagctgggctcctgggccttggtccccagaagatggcagctagggcctcgccgcgaggacagagaagggacagggtggctgggcagtcagggaaggagggtcgcccggatccgacattttggagagattctttcaccctcctgtcccccccacctcccttctctaatttcttctttttttaatgataaagtcttaaaacacagaaaaaaaaaagacttcagagaattaggtagatgaagcactttatacagtatatatcttcagcttaaatttgttttgagtattttttttatttttaagtaggcaaagatttaaaattttttatttttagtaaatgtttgaagcaaactaaaaagacgtgggcaatatttaccacaaccaaacagaacccacaaaattgtacatcttgatcttagcaaatatccttattgtagagacacttaataaagagatggtattttaatatctccagttctgaggtagggtgtaacttagttctacattgtgatttaggaatttttaaacctttcttcttcaggggagaagtgacccaggcctcgagtttagtgctaaagccactagtgtacttatgctgtcacctaaccaccacatgcgacatggaggcagaggctaaatataggggctttcttaagaaagtgagaggaaattagcaagcattattagtgtttgactactgctatcaagtgaattcaaaggaaacaggtttttatgtcatatttaagttacagaaaccaggcatgcttagaatagtttctaaggtgacagagcggccgc

SEQ ID NO: 598 - DNA, 2330 bp, Homo sapiens
aaaggaccgaggcgtgcagcggacagcagatggatcccgcggccagcagctgcatgaggagcctccagcccccagcccctgtctggggctgccttcgaaacccccactcggaaggcaatggggcctcagggctaccccactacccgcccaccccgttctccttccaccagaaaccagacttcctggcgacagcgacggcagcgtaccctgacttctcagcctcctgcctggcagccaccccacacagcctgccccaggaggagcacatcttcactgagcagcaccccgctttcccacagtcccccaactggcacttccctgtctcagacgcccggcgcaggcccaactcaggcccggcagggggttccaaggaaatggggaccagcagcctgggcctggtggacaccacaggaggcccaggcgatgactacggggtgcttgggagcactgccaatgagacagagaagaaatcatccaggcggagaaaggagagttcagacaaccaggagaacagagggaagccggagggcagcagcaaagcccgcaaggagaggacggccttcaccaaggagcagctgcgagagctggaggcagagtttgcccatcataactacctgactcggctccgcagatatgagattgcggtaaacctggacctctctgagcgccaggtcaaagtgtggttccagaaccgaaggatgaagtggaagcgtgtgaagggaggtcagcccatctcccccaatgggcaggaccctgaggatggggactccacagcctctccaagttcagagtgagattctgcatggaggaaaaatgactaaggactgagccccctacccaactacccccaccccaatcccaccttcaccctcttccttccccagccagggcagcctctccacatctttccctgactcttggatatgaaactgcccagcattcctgggagtcttaggattttctaggaagttctgtccagcctcttagcagcctcttccctagggcctttgctcccacactctcatggaatcagacagagatcctaccgggccggatgaatctggaaacagcttcagagatactgcttctcagcgtctcttggctgccacccatgcctcctcctaccgctgttctcctaggtcagccaggcctcctcctggtctggacaccacctggcctggtgggagaggagctttggaaccagctggcgactcggaaagtaaatgcttcaaaaggaaggaaatgacagagacacacgcccttgcccaccttcctctgtaggctgcacatctgaggctttggggccccttagttgtcccgaaaccccaagaaaaatcagaatgaggagagtcaaggacagcaactcagctgctgcaagccagaaacacatccctgtctccaaatttgttggctaagtggagacacttctgagaactgactagagaagacagaaaaatagcccgatgtaggtttcggtgtccccatataggcccgtccacacaggcttgactgggtggacaagaatgaacccatgacagcacctgctgcttcaaaatcaaaatcaatttagggatacagcaggggctgttgggctgtgctccagagaaaaggagcagctactccttttaaatccacgatttctggattgaaaacctgtccagatgctgagttgttgggctgaacaactaggagctgaaaacaacgtagaggctggaaagtgtcccctgcattctggaggggaggggagataataaggagggctgctgggtgagggcctggagatgtggaaccctggagtggaaggttctccagtgacagtgtcctgtgactgcaaaaggggacaagaaaatccctcttcctccatgggatggatttaagctcttgctgtgtgttctacaaatgctgttattgtgggaggaaatgctaggtttttgtgtgtggactgcccagacctcagccaggtcttctggagatgacatttgaggactgatggccaaagagcatgggggactgaagccctggctgcctcagcgctctgtctcccaacaccagctggtgttgcagagggaggtcaacgtgagtttggatctcttgtacgcagatgtaatcattcacatgtaaaaataaccccacctccccaccccaaaaagggcaagagctgtggaaaatgattgccaaatgagatggctggttagagcatgattttttctaaagcatacttcatatattttcttaagattacatcaagctaattgtgcgagctcaattcactttgtaagaaaactctcggagaaataaaatcaataaaaagcaaaaaaaaaaaaaaaaaa

SEQ ID NO: 599 - DNA, 2383 bp, Homo sapiens
gaaagcagttctctgggaccaccttcttttggcttcaacctctcccactcttgacatctgagtagctcagggaagctcttccaggtccgactgttcatatgtaaaggagactggccgctggggctcaggaccgggattatccgagctctgcagaagtgcaccgctattgctttgggaggttaaaaaaaaaatcacacggtttccagtgaaaaagtgacagagggtggtggcctttggaaccgccgtgaagtcttctgcctggaacccgaaacttgcatgctatggaacacccgctctttggctgcctgcgcagccctcacgccacggcgcaaggcttgcacccgttctcccaatcctctctcgccctccatggaagatctgaccatatgtcttaccccgagctctctacttcttcctcatcttgcataatcgcgggataccccaacgaagagggcatgtttgccagccagcatcacagggggcaccaccaccaccaccaccaccaccaccatcaccaccatcagcagcagcagcaccaggctctgcaaaccaactggcacctcccgcagatgtcttccccaccgagtgcggctcggcacagcctctgcctccagcccgactctggagggcccccagagttggggagcagcccgcccgtcctgtgctccaactcttccagcttgggctccagcaccccgactggggccgcgtgcgcgccgggggactacggccgccaggcactgtcacctgcggaggcggagaagcgaagcggcggcaagaggaaaagcgacagctcagactcccaggaaggaaattacaagtcagaagtcaacagcaaacccaggaaagaaaggacagcatttaccaaagagcaaatcagagaacttgaagcagaatttgcccatcataattatctcaccagactgaggcgatacgagatagcagtgaatctggatctcactgaaagacaggtgaaagtctggttccaaaacaggcggatgaagtggaagagggtaaagggtggacagcaaggagctgcggctcgggaaaaggaactggtgaatgtgaaaaagggaacacttctcccatcagagctgtcgggaattggtgcagccaccctccagcaaacaggggactctatagcaaatgaagacagtcacgacagtgaccacagctcagagcatgcgcacttatgatataaacagaggaccagctccattctcaggaaagaaatgttgtgatggcaagccttacccaaatatcgtttacacagagagatgactatggcagtgatgtttaatattattaaatccaggcatttcgaatctgtttttcatgatttatagagggtttacacaaagtgccacttattaaagagcttccacagtgaagatggagaaggtgaacttgctttgaatattccagatgtgtttggtcgtgcgtatggcagtgagcaggtatgtgtttgcttttgcttgcactgaaaattaaattgctatcaagagcaaactatgaacggttttttattcaagatgtctccagagtgaagatgccgaggatgaacttgcattgaacattccagatgtgtgagatcatgtgtattacagtgggcaggtatttgcttttgcttgcactgaaaattaaattgctatcaagaataaaccatgaaacattttatcctgaacagccacagtgcctgaattcactcaagtggataaaaagtgtattttaactctgtatatattacccttaagtcattttcctgtcttcactaatttagcaatgcattcatattagctgatgaaaataggcactcacaatgacaaccagagccagtttcttgtcttttttatacattttgtcatcccagagacaatcagtatgtgcttacctgtgttcaagtagagaaaaatacagtagagtctgataggacatattcttgtaccacagacaaaacaaatcttatgttgcatttactatcaactgctgctaatacgttattataaaacttacctagctcctgaattcttcctatcttatagcttaaaacaattaggatcataggcaaatcagttaccttgcagaaagagctttgtatgacagacattgtcttattttatttctgtaaaatattagctgtatgaatatgatttaattaacaagaaaacatttcttcctgattgacaacagtgttagacaaggtgcaaagcgaaactggttgctcaagttgatagaaaacaaaattctgaatatcttcaaattaaattcggtaaaaacacattattttttcatatgtgatgtattcatgcagaacaactatctttgtattttgtttttaaaatgtgtttaataaatgatcctttgtaaataaaaaaaaaaaaaa

SEQ ID NO: 600 - DNA, 1184 bp, Homo sapiens
tggaaggggccacttcacacctcgggctcggcataaagcggccgccggccgccggcccccagacgcgccgccgctgccatggcccagcccctgtgcccgccgctctccgagtcctggatgctctctgcggcctggggcccaactcggcggccgccgccctccgacaaggactgcggccgctccctcgtctcgtccccagactcatggggcagcaccccagccgacagccccgtggcgagccccgcgcggccaggcaccctccgggacccccgcgccccctccgtaggtaggcgcggcgcgcgcagcagccgcctgggcagcgggcagaggcagagcgccagtgagcgggagaaactgcgcatgcgcacgctggcccgcgccctgcacgagctgcgccgctttctaccgccgtccgtggcgcccgcgggccagagcctgaccaagatcgagacgctgcgcctggctatccgctatatcggccacctgtcggccgtgctaggcctcagcgaggagagtctccagcgccggtgccggcagcgcggtgacgcggggtcccctcggggctgcccgctgtgccccgacgactgccccgcgcagatgcagacacggacgcaggctgaggggcaggggcaggggcgcgggctgggcctggtatccgccgtccgcgccggggcgtcctggggatccccgcctgcctgccccggagcccgagctgcacccgagccgcgcgacccgcctgcgctgttcgccgaggcggcgtgccctgaagggcaggcgatggagccaagcccaccgtccccgctccttccgggcgacgtgctggctctgttggagacctggatgcccctctcgcctctggagtggctgcctgaggagcccaagtgacaagggacaactgacgccgtctctgtgagcaccgaggctttttggcctcagcaccttcgaagtggttccttggcagactgcctttcctggaagagggcacgggcgatcccgacgggggcattcctgcgggtgagagccgtccccaccgcggcggcccttctcagcccctccctccatggagggacccatagggctagacactttgaggcaagcaggaggctctgcctaatgtgaatttatttatttgtgaataaactgtactggtgtcagttggcaaaaaaaaaaaaaaaaaaaaaaaa

SEQ ID NO: 601 - DNA, 872 bp, Homo sapiens
gaggaagtgccgcgtcttggtgggtctggagctggctgacaatgcaggagacaaggtctcgccatgttgcctaggatggtctcgaactcctgaactcaagtaatccaccttggcctcccaaagtgctgggattacaggcatgagccaccacgcccggccaaattgtatgggtctctctgtgtctccagagccctgtctgtcgctgggagctccatctctcctgccccacccatcatgccagagactgcagcctcagacccccgggaggtgctggagccacagtgcagaggtggtgcccaactcagaggaccagggaccgggcgccgccttccagctcagtgaagcaagccctccccagagctcaggcctgcggttcagtggctgccctgaactttggcaagaagatctggagggggcccgcctgggcatcttctactaaatggcctcggcttccctctttccatccaggaatcagtcctgtagcttgggtgccgccgttttttttaattagtggcttttcatgttctcctttagccaaggctccttttttccaagtgatgtctttcagggaagcagtgtttgaaatagatagcgggtaccttccctggatggagtcagggcgggggcactgtcctccactgctagacacccccagaatgcctggcgctctgcagagcacagtctgagctgctctaagaaggggtctcctttaccctaaaggcagctgggcagggacaggtgggagaatgggtgtaggaggcaggccccaggctctgcttcttggtgacagttggccagagccctgtatgctttgatttttttgtacttaaaaagaaaaaacacacacacacaacaaaaaaaaaaaaaaaaaa

SEQ ID NO: 602 - DNA, 1975 bp, Homo sapiens
ccgcgtgagaattggctatatcctggagcgagtgctgggaggtgctagtccgccgcgccttattcgagaggtgtcagggctgggagactaggatgtcggacacgtggagctctatccaggcccacaagaagcagctggactctctgcgggagaggctgcagcggaggcggaagcaggactcggggcacttggatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacgccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtcagtcaggagatcctagagctattaaatactacaacagccaaggaacaatccattgttgaaaaatttcgctctcgaggtcgggcccaagtgcaagaattctgtgactatggaaccaaggaggagtgcatgaaagccagtgatgctgatcgaccctgtcgcaagctgcacttcagacgaattatcaataaacacactgatgagtctttaggtgactgctctttccttaatacatgtttccacatggatacctgcaagtatgttcactatgaaattgatgcttgcatggattctgaggcccctggcagcaaagaccacacgccaagccaggagcttgctcttacacagagtgtcggaggtgattccagtgcagaccgactcttcccacctcagtggatctgttgtgatatccgctacctggacgtcagtatcttgggcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggtcactggttgaaccatgggaaggaacactgcttggttggtgtcaaaggaaatccccaaggcttcaaccagggtctggattgtgatgtgatcgtagctgaggttcgttccaccagtcataaaccagatgaaatctatggcatgattgaaagactatctcctggcactcgcaagattgagttatttggacgaccacacaatgtgcaacccaactggatcacccttggaaaccaactggatgggatccacctactagacccagatgtggttgcacggttcaagcaaaggtacccagatggtatcatctctaaacctaagaatttatagaagcacttccttacagagctaagaatccatagccatggctctgtaagctaaacctgaagagtgatatttgtacaatagctttcttctttatttaaataaacatttgtattgtagttgggaaaaaaaaaaaaaaaaaaaaa

SEQ ID NO: 603 - DNA, 4617 bp, Homo sapiens
aaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttcttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaagcag

SEQ ID NO: 604 - DNA, 4654 bp, Homo sapiens
ggttagtgatgaggctagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacggcttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcagggctgccttgagcgacacggtggcgctgtgggagtccctgcagcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacattta

SEQ ID NO: 605 - DNA, 6217 bp, Homo sapiens
gattggcgaagctcctccgcggcccaagccagccacctacaacgtctctgagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 606 - DNA, 7345 bp, Homo sapiens
gtttctccggtcactcctgccaggggagaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaagcaaactctggagatgaacctcaccaacctggttaagcgcaacagcgaactagaaaatcaaatggccaaactaatacagatctgccagcaggttgaggtgaatactgctatgcatgaggcaaaacttatggaagaatgtgacgagttggtagagatcatccagcagaggaagcaaatgatcgctgtcaaaatcaaagagacaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagagggtcgctatggcaactgcatcttctcaagttctgattccagacatcaattttaatgatgcctttgaaaactttgctttagatttttccagagaaaagaaactgctagaggggttagattatttaacagccccaaacccaccatctatccgagaagaactctgtactgcctcccatgacaccattacagtccactggatctcggatgatgagttcagcatcagctcctatgagcttcagtacaccatattcactggccaggctaacttcatcagtaagtcatggtgtagttggggcctgtggccagagataaggaaatgtaaggaagcagtaagctgctcaagattggccggggcgccacgaggcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaataactagatattgcagatttaatttttgtgcattaaagcttgtatttgaattaatttattgagtttttcagaacaaattatctgagtagtctgcgttcaagccattggagaaaaatttagaaaatgcctctgttgtcattggagaattaaaaattcccaatgatttaagaatataaattatattggaagcaattagggtaattctagttaaataatgtggaaaggtgccctgaataaggagctagcaagccagagcggggggtggtcagcctttctagtactggccagtttggccatgtagaattttgaacagtgtcaaattatcacatattatattttacttttgatgaaaacctatcatcaagggtttgttaggaaaccatgaatgtgtatatgtaatatataaagtgaacatatatgtactttatatatattcacttgtgtatgtatgtttatgcatattcactttatatattacatatacacaaaaaacttttttttccaaacaccacctcgaactagaacaaaaaactttttaatttgctaatttgagtgagaaatatactggaagggaaaataagttacaccatccatttttgtcccctaaaggaaacatcaaaatcaatcaacatttatttcctccctctatccatcattgccttcctccctcctgtcacgcacacatacacatgcaaccatgacacagataatgggaagagctttattggattagcagagatttacagacaagattgcacaagagatgctgttgctggatagaaaattgatcaggtagaagtgatgctacctacttgaggatggccatctgaattgttaaaaattctgtcatagactattaaaaaaaaagttttactactcccaagtacacacagttatgagaattaggcttttaaaaagttgcacagtgaaggctctttaggaacctactttacttaatcagtaaaaattgagtattattgatgcaccaactattcccatataaatgtacttgctttttcagataaaacacttctgaagtgctcaagaatgtctgaaaacagtttgttttcttaaataggataaataatcattccttttgcaatcttgtttacagtattcattctcttagccaatccctccacgcaaatggagacaaacttcatcccagtcctaaccagtatagttgaagggaatggagccttgtagtctatgatttttttttttaaatttccatcgaagggattggggatgtcagagagccagagctttcccctttccaggagctaagttggcttcggaagtcttctgggatttgtgaaaatattactgttgtaaaattacaaagtggtagccataacaactccctcagattggagacttgaaatgtcaaaactcccctcttcctttcccctagtttggtggatgctcatttattaattcattcaataaactattagatgccaggtaccaaactactgccatgggagtgcacatattaacaaaatgctctacctgctgccaaatggcttactattctgtggaagaaacaaagtatataatcctccccaataacagttatgtattgtttgttcacttaatgtggaaggcaagactgatgcagacacacaaggaaggctcaaaaatataaatctagcagcaatgtcatcttttttgattttaaataccatatgtgcttactgctaatcaggaaatgaacaacctcagtaaaattcatcagtgctggtaaatagtttgctgtagtggaaagctcataacctttggattcaaatgatcctagtttctgtaccatttattagcgttgtgacctaggacaagtacctcacttctctgagcctgtttcctcctctgtaaaataatgtctacttcacaaggctgtttcaaaggttaaaaaagatagcatatgtaaactgtcttagctcagcgcttgacatttcctaagtgtgccataaatattaatctctttccttactcccagctccaatacagcgtaacagtgctttaaaatgtatgtccttcatttctccttcatttctcagtcacctttgtctcttccctagggcatatccccaaattcttaaacaaaaaaaaatgatttttttccccttcatcaaacttttcactggctcccttagcacccagtagaaggtcccaactccttacagagtctgggttttcatgtccctgtttgcttacacagcttaatcttttgccactttccccctcacattgattaaggtagccaagtttaactatttacacaactattcacacaagttattctctgggcctgcagcagaaacatgattaacaattttaatgcccagagtaaacaacagaaatttttcttaaattaaaggaatagtgtgaaaatgctgtaagtacagaaaatgcaacctccattccagtagaacaatttcctttgccttgtccttggctctccaaaactgttcatttattgtggtgtcttttagattttagtgccctgggacaaagatctaatttccccaccctacttttgactctatcctggactacctttcctcacctctatctctctcaaccagactaactctttattccttagacttgatgatgcatccctctttagagatccaaagacaccccaagcatccccctctctcagcaataatcacattgtatagcagtgtttttcaaagtgtggtcctcacaccgcctgtgttagaatcacctttagtgtttgttaaaagaattgattttgggttcccactcctgacctaaccagaatatctgagaacataggcaggaatttacatttttgacaagctcctcatgattctgatgcaccaaaaattttaatgaataatcatcttccctactagactgaacaccttgagaggaaggactgtgtcttttattgttgttatattgttaatacctggcacagtgcttggaacattagcttggctaatgtttattgaatgaatgtatgaatgaaaaaatgcattatgaaagtttcctcttgtactctcatgttcgtagtgatgtttgttacttcctgggcagaaaagcttggttactactccatttgagctgtattaattctattttgcagagatatcaaggctcctacataataaatgatcattgtcctcctcaaaaactctttggcagttatcttggggaaatgtctttggagcatatggcaccattgttttcagtaacatttcagtcttgtcaaactttgttgtttgaaggtggatttacatttcggttatagccaaaaatcactcaaagctaagcctacttaaaaaagtggggaattaaactgggtttggagtaagcaatgaagtttgactctgaagtcccaaattctgagtcaaacagtgaaaaatgacttctaagatacaacatggtgacaaagtacttagtgggggtgcgatgggccccagatatttacttcagttaacttggcttttatagaatcctggcaatgccatggaccttaagagaagtaattggctacctctagctaaacccagctggacaaagagaataggacttgtatttaacattttcaaagaaggtgactgcataagcttttgttgttgttgctctactcaacctgttctccacaactgtttctaccagaagattattttatgtctgcaatttatgcttgtttccactttttatattgtcttattgaagaaagcacaaaaataatcaaaaataaagtaaaacctgttttgagagtatgaaagaaattttaatgccacattgaggttctggctacttgtaagtaagagtaactgcatctggatgtgtttttattatacaattctatgtgtatctttagatgcagtgaaattcagattgcagcaaaatcacttatctgttcttttcggctaaaacactctaggtgaattttctaaacttccatggtttacatatttatatatgactaccaagatggagcaatccacggatggacttttgaataaactcaaatatttgatactgcttcctccaaggaatggagagtgtcaggcaggtaggtaagaaccactcctacacttatttctagctcctgaagccaactgcagccttggagccaatggctgtatttggctgtgtgttacaggttggccaaactgattgccatcaggtcagacaaaactgccttttatggtgtagtctgccagcttcagacatatgctgtattgttgttattggctagactatttattagactattgttggactattttttatcaaatgctttaccccacgcctgtttgtattgggagctctggaccaatagtgtctctcctagtgacagaaatatgagcatctgtggattacacagcctcatccctctctacaatattccagcccatccaaaatgctatattatgaattaaataaatatatatgtattcatgaa

SEQ ID NO: 607 - DNA, 5643 bp, Homo sapiens
aggagggcggaggcggaggggagggcagagggttggtggagctggaggaagctccggacgacgactggaagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgaaaatgtgcatcagatgtttatgtttaattggtttacagactgtctgtggactcttttcctgtcaaattaccagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattggaaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaatattttctttgctatcgatggataattaggagtgggcacttggaataactgagggctggtgaatataataggcaatatttacatggggtgtgtaactaaataccaaatcagatagtaaggttttcccaactataatccatattcatgaaaaatgccagtgtggaaaaccatgtaacatacagaagaacaggagtttccaaattttaaccttttattctaaaaatgactctcttctctcaaaatgactttttctgtatcacataattctactgatacaactttttaccgtaaaaattaactctcttctttaatatcaagttcatcctttgcagaatcttaaagggttttccacacatccatccacccacttacagactgatttcatgtatctgaatatctgattaacctttcttttctaataccagttttccataaactcttgtcatgtacccttagtattgtgctgatcttttgccaactatacggacgtggagtttttccttttcagaatatgattattttcaatttgtctttagttagtataaagaattatagaatgtataatgtaattaaaatgtcattttgcttgcaaaaaaaaaaaaaaaaaa

SEQ ID NO: 608 - DNA, 699 bp, Homo sapiens
atggccacagccgagtcccgtgcgctccagtttgccgagggcgccgcgtttccagcgtaccgggccccccacgccggcggggcgctcctgccgcccccgagccctgcggcagccctgctccctgcgccgcccgcgggccccggcccagcgacctttgcgggcttcctcggccgggaccccgggccggccccgccgccccccgccagcctgggctcgcctgcgccccccaaaggcgcggccgccccgtcggcgtcgcagcgccgcaagcgcacgtctttcagcgccgaacagctgcagctgctggagctcgtcttccgccggacccggtaccccgacatccacttgcgcgagcgcctggccgcgctcaccctgctccccgagtccaggatccaggtatggttccagaacaggcgtgccaagtctcggcgtcagagtgggaaatccttccaacctttggctaggccggagattatcctcaaccactgtgctcctggaactgaaacgaaatgtctgaagccccagctgcctcttgaggtagatgtgaactgcctgcccgaaccaaacggggttggagggggcatctctgactctagctcccaaggtcagaattttgaaacctgttcccctctctctgaagacattggttcaaagctggactcatgggaggaacacatcttttctgcctttggtaacttttga

SEQ ID NO: 609 - DNA, 4490 bp, Homo sapiens
cgggataccttgtttatagtaccttctctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagcgtgtatttttcccacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacataaaaaaaaaaaaaaaaaaaaaa

SEQ ID NO: 610 - DNA, 4530 bp, Homo sapiens
ggttccgcggggctggcgggcgagcgggcggccgggatcggcggcggcggcggcggcggcggcgcttgacagacaatgagggcggcggggcggcgttgagcggcggcggcggcggcggcggcggcgagcgacgcggggcccgggggcggggcggggcgccagccatggacaatcagtgcaccgtccaggtgaggttagagctggggcatcgcgcccaactgcgcaagaagcccaccacggaggggttcactcacgactggatggtgtttgtccgcggccccgagcaatgtgacatccagcacttcgtggagaaggtggtcttctggctgcacgacagcttccccaagcccagacgcgtgtgcaaggagcccccctacaaagtagaggagtcggggtacgctggcttcatcatgcccatcgaggtgcacttcaaaaacaaggaggagccgaggaaggtctgcttcacctacgacctgttcctgaacctggaaggcaacccgcccgtgaaccacctgcgctgcgagaagctcaccttcaacaaccccaccacggagttccggtacaagctcctgcgggccggcggggtgatggtaatgcccgaaggagcagacacggtgtccaggcccagtcccgactaccccatgttacccacaattccactctctgccttctctgaccccaagaagaccaaaccatcccacggctccaaggacgccaacaaggagagcagcaagacctccaagccacacaaggtgaccaaggagcaccgggagcggccccgcaaagactccgagagcaagagctcctccaaggagctggagcgtgagcaggccaaaagctccaaggacacctcgcggaagctgggcgagggccggctgcccaaggaggagaaggcgccaccgcccaaggctgccttcaaggaacccaagatggccctgaaagagaccaagctggaaagcacgtcccccaagggtgggcccccacccccacccccacccccaccccgggcttccagcaagcggccggccaccgccgactcgccaaagcccagcgccaagaagcagaagaagagcagctcgaaggggtcccggagtgctccaggcacctcgccccgcacctcctcctcctcctccttctcggacaagaagccggccaaggacaagagcagcaccagaggggagaaggtgaaggccgagagtgagccccgggaggccaaaaaggccctggaggtggaggagtccaactcagaggacgaggcctccttcaagtccgagtctgcccagtcaagcccgtccaactccagctccagctcagactccagctcagactcagacttcgagccatcccagaaccacagccaaggacccctgcgctccatggtggaggacctgcagtccgaggagtccgacgaggacgactcttcgtcaggcgaggaggctgccggcaagaccaacccggggagggactccaggttgagcttcagcgacagcgagagtgacaacagcgccgactcctccctgcccagccgtgagcccccacccccccagaagccacccccgcccaacagcaaggtgtcaggccggaggagccccgagtcctgcagcaagcctgagaagatcctcaagaagggcacctacgacaaggcctacacggatgagctggtggagctacaccggaggctgatggcgctgcgggagcgcaacgtgctgcagcagattgtgaatctgatcgaggagactggccacttcaatgtcaccaacaccaccttcgacttcgacctcttctccctggacgagaccaccgtgcgcaaactgcagagctgcctggaggccgtggccacatgaccctgggccgcgtgccgggcccccaccgccggggtcctgggaggctgcagccaggcctcgcctgccctcctctcccgtctcgcctgcccgcagcactgccttagcgacagccctgtcctcgcccgcacagcccgctgcactttcctcggcggctccctgcccactctccccgctccatcgccaggagccctggggccgggctgggccacacgggagccgccccccgggctctctgggctcccctcagagagcggctggtgttgaaggcagctctgggcagagacagggccgggggcccctcgcccagccttgggaccagcccccactgctcggcgggctgtgcggcgtcgctgccccagcctttctgagcagcggatcgacggctggggggcatctccagcctcccgaatggttcagaacacaccctccgcccaccctggacctcagaaggccctgcctgtgtgtctgcgtcgtcctccgtgtagacctagcgccggctcctccccggctcgcgctgcgctggggtctgtgctgtatagttctctctattatatatgtgtgtgcactgtctggtcaagagcagtgtccatgtgcgtttctgtggcagcagtgcacgtggggtgggtggggggtgcgtacggtggggcttgtaggttaagatgtctctgcggtggtgtggggctggaggccgagccaggcacggcagctggccctctccaggcgcatggaggaattctccctttgccgttccaaggatgccgccgcctcctaccggggctcccgggggggtcagccaacactacaaagggcagcgagtcctcagggcgcccgggagccaccagtctgctctcgggctctactcagactagcgccaacagtctccgcggacagactcgcatcagccgccctggggctcggcctcctcccataggctcctcttcctctctttcattcaagtcttcaaactttgaaaaaaatatgagcttttgccaaataagacgggatagtttatggagttttctgaggcgcattgaactctggtcagcccctcgagcgtgggctcggccatcagcaggcccggtgggttggccgggctggccctcccaggctgcctttctctctggtcgcggcctggcccgccccggcctccaccgccgcaattcatgctggtgccgcgcccgcagccccactcctggtatgcctgagattctccaggggccaagccggtcctccttcccggcccactcttccagggccaggacgctcccgcggagccagcccatcgtggctgggggtcccaggggctggaggcctgcctggttagcctctgtttcccagacattgactcgaggcgcctccagtcctctcaaccccctgactttcaagtcctttcaagtccttgtgccctgaccaagttatgaggaaaagagggctgagggcctggaggtgggctcgcaccccctcgaacccacctagatgtctcctcctccccagcctatgagttcagacttggggggctccatctgtccctccctgaggtccctcatcttgtccctgctctgattctgtcagcagatcctgaacactccttggtggggacccatgcctccaaggctgcccccaatgccagctgtcctggggaaactccccagaactctcggggaaaggcccgagaaccttcggaggaagcctccgggactcctcgccacctgctctgtttctctcccggccccactgccttcaggtatcaggaagagggcaggcccctgtgccccctctccccttcccagggcggccaacaatactccaccatggggcgcttcctttcttctctggaaactaagacattggactgaaggaactggcctgaggggggctgaccgggggcccgtgctgctgggagctctacgcacaagaggccgccggggtcacggacaggaacctcagcccagggtgctggcctttctccttcgcaggagtcccccaaaatccacacagcgactcgagcagccttccactcagccagaggagggtcgggctcccccgcctgctctcggtggtggcgtctggcccttcctgccgtttccaaggcctccggaagcaccaacccagttctcagttacctcctctggccggaaggcctcacgttgtcctccagagctgctctgggcccagggctggctccgtgaccacctgatggacgtgctgggcagcatgggctcccaaggcagcatccccagctgctctcccaccccaccccagctgcccggcggctgggcccacgagggctctggggacacttccataggaaaggggcctggcactttgtgattgccacgtgtttcctgttaagccgcctgcccccagtgcaaatctctgtgttttgctctctcctgaacaaaaatgtaaaccgacgccggaaagcaaatggtatcgaatacctttcttgcccataagggtttttacaaagaacgtgtctcactaggaactaggacactcatcggcccgagaccaactcctggataaaaggaataaggagaatcgtgtttgtaacgagttacaggattgtttctttcctggattttaaacttttgttaaattgtgaaattatggaggagttttatagaaaaaaaaagtgaaataaagtcagatgggaaagcaaaaaaaaaaaaaaaaaaaaaaaaaa

SEQ ID NO: 611 - DNA, 5140 bp, Homo sapiens
cgcgcacgcagggctagcctcgcccaggcctcctccctcacgccggccgcaggacgggcgcgcacgccaagtgacgctccgaggaggaagcgcagcccccttcccctccctcgctgcccctggcccagcgggagccccccctccccccagtgcgcctgtgcggaggccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacgacagaggtgacagttctacactaacaaagcaagaacttaaattcataggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgttaaaaaaaaaaaaaaaaaaa

SEQ ID NO: 612 - DNA, 9378 bp, Homo sapiens
cctttctaactgtggcccgcgttgtgctgttgctgggcaggcgttgggcgccggcggtcttcgagcgtgggggcccgctggctttcccttctcagaaactgcgccgggggcgctcgcttgccccggattcggacgcggcgctccccgggctcgtctgaagtgcagatcgccgcagaggccccagtgcccggatgtccatcaggattagcgcgagccaatacgggccgagcccggggctgcgccgaggacgcccggggctcgagagcaggtagtcccgtaacatcggggcgccgcgccgggacgcgtccccgcccggctccgccaaatggtgagcgcggcgctggcagcagggcccgcggggtgaaggcgctcatggacggaagacccctggctctataagctgaattatggcagcccagtcaagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggagcctgagcctccaacaacaaacaaatggcagctggacaactggctgaccaaagtcagccagccagctgcgccaccagagggccccaggagcacagagcccccacggcggcacccagagagtaagggcagcagcgacagtgccacgagtcaggagcattctgaatccaaagatcctccccctaaaagctccagcaaagccccccgggccccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcagggggaaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcggcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctcccaaaagtgccagcagtaccaagagcaaccacaaagactcttccattcccaagcagagaagagtagaggggaagggctccagaagctcctcggagcacaagggttcttccggagatactgcaaatccttttccagtgccttctttgccaaatggtaactctaaaccagggaagcctcaagtgaagtttgacaaacaacaagcagaccttcacatgagggaggcaaaaaagatgaagcagaaagcagagttaatgacggacagggttggaaaggcttttaagtacctggaagccgtcttgtccttcattgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccgcctttgacctttgggaacaggccgaggccctcacgaggaagaataaagaattctttgctcggctcagcacaaatgtgtgcaccttggccctcaacagcagtttggtggacctggtgcactatacacgacagggttttcagcagctacaagaattaaccaaaacaccttaatggagccccaggttgattcaatgccttgggaactatttttgcacattggaagcctcaaaaacagtccagacatttgtttcatcaggacaccaaactctaaaaaagaagcaccacgagatggccaggacatttgtccacttaaactctcaacaacagtgtgatcattggttggacactgtggttatgcagaagcagagatgaggaggctggccccagagatgatcttgcccttcctaactaaaggacagaagtgcaatttagcttaaatgggtgtatgaatggtctagaaacatttctattttttttttaaaccagcaggatacaagttgcaaatgaaatgaggagaaacagtttcaactctgaaagtgaatttcacgtcatctcagtagccacgctagtccattcccagaaggaaatttttttttttaacaatgacttttggtaaagggttttgtggatgattttttttcttttgagttttgggagaaatatttgtttagtaacttctaatggccatctgtaaaccataagtaatgaaggactccactgtgccccactttctgccaatgaacagtggcttgataataccaagtattgttgtaatttataaaattgaaggcaacccccgctcctgccgcccccaatctccccattgcctagagcgctgcacattgaccccagctctgacttctcattactgtgctgaaagtcagcccacgtcggagcggtgaggaggagccacagcacatggggtgccacctcgaggtctgcacaggaggacttggcgctgccatttcctacccctgccatttcccacccctgcttcagcgaaagggactctctaacagggcagtcactgttgactctattctgaatttcctcccttggggaagaagggaaccaacatttatacctgaccagatggctaaagtgcttttaaagttttgtttaagtagagctggaatttgaggtgctgatctgtggtctacagttatgtggtaactcatgttgtccagccaactcagagtttcgtcagtgaacaagaaacatgaaatctgcttcttagagaggctatatttttctgctacaaatattttatatttatagcaaaactagactttcagagtccttgattgtctaggggaagttaactccctgagaggatgtagagatttggggtggttgattagacttttgaaaaactcatcaccacatgccttcactccagagtgttctcagctagatttgatttggttgaggaggaactgtggccctccgtaagttattgccatagtgtatgcattaaaccaagtccattttgaatgacctaaaatgaagtaacacaatcagaaatcccatgtgcccataagcacagatttttctttttcattgaaactttaaaggttattattggaaacattactttgagtgcagtgtttttaaaagccaattcttttttatcccttttagaagtagaatttgcacacttactacaattgaggagtgtcatctctataactttttctccgcctttgtcccattctgcccctgtacatgtttcctaccaagcatgtttcacattttcctattagtggaggagggagaaccatatttatttataatgaagacatctaagatccctatgatgaatgcaggaactctcttggtagtttgtaaatacacaaagggatgtgtcgagggatgggagcgatgcttatctctcacagtgtgagtggtctgtgtgaggctgttccttcagtttcttctccagactgttctttggttgtcactaagtcagaggtctggtccctcatgtttaggtgaaagccagagaatgacagctgtagtcatatctgagcataagaccttgatgtgtgattcctgatgaccggtttcatttattcatgttataaagcaaagccctggtcctttttaaactactagttttaaaaacctgtgttaaatgaacagtaattgcctggtaggtttggtgtgtgtgtagcattgtgtgtccatctgttatatgtaaaggacaaggcaccagaatcaggctttatttcgatattgaagatgttatttaacatctttcttttttccttactcccttagccatcccctccccttttgtcctatcattccctagaacaagccacctgtcaattgtgaagggttgtgttctttatggcaggttctatgcagattgtgccagagcatgtgcgtgttctgttggcaagccacagtgctcccttgactgaagacatttccaggtagatttctcagccagctctaaaacagattgctttttcagtggccttactctttgtgggtttttttttttttctctgaacttgatataaagattttatttgtcccttgaaaaagtaacaaatgtgcatagatcaatttgtactactttggtcattggatatttctgatccttattgcattgtacctaaaggagagtaactaatggtaacctttttaatagagtatgtgaaaggtagtggctgatgaatccttaacgttcatagggtctttttgctgttacggttgtatatagaggtctgaaggatttttaaaatgatttgcactttttcactgcatgcttacaattcccaaaggcaaaatctgtactgaggtagatcatttgaaagggctagattataaaattaagccttagagtatggaaagttcttataacaataatagtacacacttcagagtaagacaaatgcaaagcatcttaaggagtgaaaatagagtgtaaatcttgcctttggcactacaaggtgtgtgtgtgtgtgtgtgtgtgtgtgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttgactgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccctcctgttcttgagccagttgtctcttttgttttgggtcccacttaggattaatggatgtaaggtattttcctgtgcctttattttgtgtcattctattggaaggaggtgtaacggcagaatagcatcgtgttgggggttttccttcaaacactgcaagtgatattgccaccatgtgaacctcaaatatgcaatccagttgtgttggtttctcggtgacttggagtgttcatctcttcatgaattgtgagcactgaccatgttcttcagttcttaattatggtgagttgacaaataccaactactgcttttctttaggtggctataaatttcttactgtcaggaggaaatgacattatattctgttccactgaacgtcagagatcagcaggcactgtactgggtagagaagtgcctatacttctctacctaagagggcaggagggaaaccctacagctccttgtgagcctatatattagtatatcggcctggagaggacaagggaataagaccactcatagtgaggctggccaagctgcactggtcggaccaggcagtggctgacctaaggaagacaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggatgatacctgagcagggttgccttttttttatttattaccattatatattatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatca

SEQ ID NO: 613 - DNA, 3439 bp, Homo sapiens
acggcgcatgctccgcaatcatcttctttaccctggagctgctgctgctgctgctgcttttgcttttggggctgagtttaataagcgagcgagcgagcaagcgagcgcggggggaaaaaggcagagaatgtccgccatctaccctccgctcctgggcgcgctctcattcatagcagcctcttcatgaattacagctgagggggggcggaggaggggggggtaccacacaacaccccagcaaacctccgggcccccaggcatggctagctcgtgtgccgtgcaggtgaagctggagctggggcaccgcgcccaggtgaggaaaaaacccaccgtggagggcttcacccacgactggatggtgttcgtacgcggtccggagcacagtaacatacagcactttgtggagaaagtcgtcttccacttgcacgaaagctttcctaggccaaaaagagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcagtagcagcagcagcagcagcagcagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaagtgtacctgtaaatgtcctgaatccagcattgttgagctgtcatcaacattcttgtgtctgttttactgttacaatattaggtgaatatggaagtaaaggcattccacaggatcatcatttaaaaaaaaagaattctggtcctgttttctaaaaaaaaaaactgttgtagaaattcttaatttggatctatttattagtcagagtttcagctttcttcagctgccagtgtgttactcatctttatcctaaaaatctggaatcagagatttttgtttgttcacatatgattctcttagacacttttatatttgaaaaaattaaaatctttctttggggaaaaattcttggttattctgccataacagattatgtattaacttgtagattcagtggttcaatacctgtttagttgcttgctaatatttccagaaggatttcttgtattggtgaaagacggttggggatggggggatttttttgttcttgttgtacccttgttttgaaactagaaatctgtcctgtggcatgcaaaagaaagcaaattatttttaaaagaaaaaaaccaaagtacttttggtgtcattattccatcttctccataagtggagaaatgaaaagtaagaacagctcatcttcaaagtttttactagaaattc

SEQ ID NO: 614 - DNA, 4981 bp, Homo sapiens
gcggccgcggaggcggaggcagccgcggaggcggaggcggccggcggggggtggcgaggggcgccgggcccccgcggacctgtcgtcctcggcccgtcctccggccccggccccgcgcggctgaggaggcgcggccaggaccatgtcggcgggcggccgtgacgaggagcggcggaagctggccgacatcatccaccactggaacgccaaccggctggacctgttcgagatcagccagccgaccgaggatttggagttccatggagtgatgagattttattttcaagataaagctgctggaaactttgcaacaaaatgtattcgggtctctagtactgccaccactcaagatgtaatcgaaacgctcgcggagaaatttcgacctgatatgcgaatgctgtcctctcccaagtattcactctatgaagtgcatgtcagcggagaaagaagattggatatagatgagaaacctctagttgtacaactgaattggaacaaagatgatcgggaaggcagatttgttcttaagaatgagaatgacgccattcctcctaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgttgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggttatgcttcctcctggagcccagcattctgatgaaaagggtgctaaagaaattattcttgatgatgatgagtgtcctttacaaatcttcagggaatggccaagtgacaaagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccagatggttctgactctagagataagccaaagctttaccgccttcagttaagtgttactgaagttgggacagaaaagttggatgacaactctatccagttgtttggcccaggaattcagccccatcactgtgaccttaccaacatggatggagtggtcactgtgacgcccagaagtatggacgcagaaacctacgtggaaggccagcgcatctcagaaaccaccatgctgcagagtggcatgaaagtgcagtttggggcgtcccatgtatttaagtttgtggaccccagtcaggatcatgctcttgcaaaaagatctgtggatggaggcctgatggttaagggcccaagacataaacctggaattgttcaggagacaacttttgatttgggaggagatattcatagtgggacagcattaccgacaagcaagagcaccactaggctggacagcgacagagtgtcgtctgcctctagcacagccgagcggggaatggtgaagccgatgatcagagtagaacagcagccagattatcgcaggcaagaaagcagaacacaggatgcttctgggcctgagctgatactacctgcaagcattgaattcagggaaagttctgaagattcatttttgtctgccattataaattatactaatagctctacagtccactttaagttgtcccctacatatgtattatatatggcatgccggtatgtattgtccaaccagtacagacctgacatcagccctacagagcgcacacataaagtcattgcagtcgtcaacaagatggtgagcatgatggagggtgtcatccagaaacagaagaatattgcaggggcacttgccttctggatggcaaatgcatctgaacttctcaacttcattaagcaagaccgagaccttagtcggatcacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgacccagattcggggctgtgctcccattactggggtgcgattatccgtcagcagttgggccatattgaagcctgggctgagaagcaggggctggaactggctgcggactgtcatctgagcaggatcgtgcaggcaacgactttgcttaccatggataagtatgcacctgatgacattccaaatataaacagcacctgctttaagttaaattcattacaacttcaagccttattacagaactatcactgtgcacctgatgagccttttatcccaacggatcttatagaaaatgtagtgactgtggctgaaaacactgccgatgagctggcccgcagtgatggaagggaagtgcagttggaggaggatcctgatctgcagctgccgtttcttttgccagaagatggttattcttgtgatgttgtcagaaacattccaaatggtttacaagaatttttagaccctctgtgccagagaggattttgcaggttaattcctcacacacgttcaccaggtacttggacaatatattttgaaggtgcagattatgaaagtcaccttctgcgtgagaacacagagctggctcagcctctgaggaaagaacctgaaataatcactgtgaccctaaaaaagcagaatggaatgggccttagcattgttgcagcaaagggtgctggtcaagataaactaggaatctatgtgaagtcggttgtgaaaggaggtgctgcagatgtggatggacgtctagctgcaggtgatcagctcctcagtgtggatggacgaagtctggttggactctctcaggaaagggcggcagaactcatgacaagaacaagctctgtggtgacactggaagtagcaaagcagggtgccatctaccacggtctggccacccttctcaatcagccatcccccatgatgcagagaatttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaaatcagcctcctagtcctggagggaaaagtgcatatgcctctggaacaacagcgaagataacatctgtctctactggaaacctctgcactgaggagcagacgcctccgcctagacctgaagcctaccccatccccactcagacgtacaccagagagtattttaccttcccagcttccaaatcccaggatcggatggctcctcctcagaaccagtggccaaattatgaggaaaagccacatatgcacacagatagtaatcattccagtattgcaattcagcgtgttacacgttcccaagaagaacttcgagaagataaagcttaccaacttgagcggcatcgaatagaggcagctatggaccgaaagtctgatagtgatatgtggataaatcagagctcctcactggactccagtacctctagccaggagcatctgaaccattcctctaagtcggtcacccctgcttccacactgaccaaaagtggccctggccgttggaaaacaccagcagccataccggccacccctgtggccgtctcccagccaatccgaacagacctgcctccgccacccccgccacctccagtccactatgccggtgatttcgatggaatgtccatggatttgcctctcccaccacccccttccgccaaccagatagggctgccgtctgcgcaggtggctgctgctgaacggagaaagagagaagaacatcagcgttggtatgagaaggagaaggcccgcctggaggaggagcgggagaggaagcggagagagcaggagaggaagttgggccagatgcgcactcagtccttaaaccctgctccgttttctcccctgactgcacagcagatgaagcccgaaaagccttccacactccagcggccacaggaaacagtcattcgggagctgcagcctcagcagcagccccgcacgatcgagcgcagagacttgcagtacattacagtcagcaaagaggagctttcctcgggggacagtctgtcccccgacccgtggaagcgggacgccaaggagaagctggagaagcagcagcagatgcacatcgtggacatgctgagcaaggagatccaggagctccagagcaaaccggaccgcagcgccgaggagagcgaccggctgcgcaagctcatgctggagtggcagttccagaagagactccaggagtcgaagcagaaggacgaagatgacgaggaggaggaggacgatgatgtggacaccatgctgatcatgcagcgcctggaggctgaacgaagagcgagggtaaaggggggagtgctttggctgtgcccatctgtggtccctattttagcttctgcgtgtttcccatggggatag

SEQ ID NO: 615 - DNA, 7500 bp, Homo sapiens
agctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgagtgtgtgtgtgcgtgcatgtgtgtgtgtgtgtgtgtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgcaaaaaaaaaaaaaaaaatccgaaga

SEQ ID NO: 616 - DNA, 3365 bp, Homo sapiens
aaaagggggagggaactgcggctaaggagacgttcggtgatgggagcgcaatatatgaggggatacagtgcctcaggtttaaaagagcaggaagctgagtgagaggttgcagaaaaagtgtcttcgctcggcagaggttacaggtggcatctcagaaagagctttgaggctacaggctgtagtcgggaaggggatcggagaactgtgtgaagggacagcttagggactagcgtcctgggactagggggaagttcgcgactttctgaagactggcaggaatgtgcctcctggccctcgatgcttcccccctgaggggaggcatcgtgagggactgtggcaggcttcactgaacgctgagccggggaggtccaactccacgtatggatccggggaatgagaattcagccacagaggctgccgcgatcatagacctagatcccgacttcgaaccccagagccgtccccgctcctgcacctggccccttccccgaccagagatcgctaaccagccgtccgagccgcccgaggtggagccagatctgggggaaaaggtacacacggaggggcgctcagagccgatcctgttgccctctcggctcccagagccggccgggggcccccagcccggaatcctgggggctgtaacaggtcctcggaagggaggctcccgccggaatgcctggggaaatcagtcatatgcagaactcatcagccaggccattgaaagcgccccggagaagcgactgacacttgcccagatctacgagtggatggtccgtactgtaccctacttcaaggacaagggtgacagcaacagctcagcaggatggaagaactcgatccgccacaacctgtccctgcacagcaagttcatcaaggttcacaacgaggccaccggcaaaagctcttggtggatgctgaaccctgagggaggcaagagcggcaaagccccccgccgccgggccgcctccatggatagcagcagcaagctgctccggggccgcagtaaagcccccaagaagaaaccatctgtgctgccagctccacccgaaggtgccactccaacgagccctgtcggccactttgccaagtggtcaggcagcccttgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggataacatcatcagtgacctcatggatgagggcgagggactggacttcaactttgagccagatccctgagtcatgcctggaagctttgtcccctgcttcagatgtggagccaggcgtgttcatatctactctttacccttgagccctccccaggaatttgggaccctgctttagagctagggtggggtctggtcacacacaggtgttgaagaaattataaagataaagctgccccatctggggacgatatggggagggagatgggaggggaaaggggagagggtttttctcactgtgccaattagggggtaaggccccctctcaggagccatcatcggctttccccattcctacccacttaggctttgtagcaagatgagcaatgctgttggaaatgtgaagtcaccagtggccttacccctgcctttgggagcaggatttttttgtagagagtcttatctgagctgagccaggctagctggagcctgggatttctatgcagtggccccttaggccagtgatgtgcggtgggtgggctgtttaggggatctggaagggccaaggtctgagcactggagtggctcgccaggccaaatcacccttagaaggctgcagataacagaaaggctttttataaacttttaaagaaatataaacacaaatatagagattttttaaccatggcagggtgctagtggtgggcagaatgcttttttttctttctgaaggctttgtgatagtgacatgatacaaacactacagacaataaatattaggagacacagggaagtggggagaggtggggagtaatagtaaacacagggaagagctcccctacggaccaggtatagagaaaggtctatgcagaaataggttagagtttccctaacaaaaaagctaacccaggtcccctcattccttcaacttgtgcctgggagtgtgtggtgttagggtgcagccacactcttctatgacccagcatgggttagtgctatggtgggagagtacattgaaggcctggaattagcttggggccagggaagggactgggaggggagagaagagaaggagggaaggatttaggatggtaaagttaggtacagagacctccctgttcaaggcccctgacagctgtccctgcccttcttccccttccctgactgcaggggttatgtggaagtgtgtgtggcagcaggcagcggggaggggaggaacagggaagggggagctggggagcttggctgagggtctgggaaatgagcagggatggggggggatgtggatcaggtttactagcacctgccagggaggccatctggggctccttctccaccccagcccccaaagcagcccttcccccagtgccctttgcatcgtcccctcccccacccctgctgtgggttcccatcatttcctgtgtcagcgcctggcctacccagattgtatcatgtgctagattggagtggggaagtgtgtcaaatcaataaatgaataaattcaataaatgcctataaccagcaaaaaaaaaaaaaaaaa

SEQ ID NO: 617 - DNA, 1388 bp, Homo sapiens
gtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaaaaaaaaaaaaaataaa

SEQ ID NO: 618 - DNA, 1670 bp, Homo sapiens
attgagagtggctctaacaagtgccatttttccttgttagctttcatttctcagccctttacaagattaaaatagtctgcagtttaatctctccaaagctttacggacagtgattctgtcctaaacaagacagtgactccaggatttctgaagactattgtggaagaagcatccattaaggccaagctataacatcagaaatggtgaatgaatacaagaaaattcttttgctgaaaggatttgagctcatggatgattatcattttacatcaattaagtccttactggcctatgatttaggactaactacaaaaatgcaagaggaatacaacagaattaagattacagatttgatggaaaaaaagttccaaggcgttgcctgtctagacaaactaatagaacttgccaaagatatgccatcacttaaaaaccttgttaacaatcttcgaaaagagaagtcaaaagttgctaagaaaattaaaacacaagaaaaagctccagtgaaaaaaataaaccaggaagaagtgggtcttgcggcacctgcacccaccgcaagaaacaaactgacatcggaagcaagagggaggattcctgtagctcagaaaagaaaaactccaaacaaagaaaagactgaagccaaaaggaataaggtgtcccaagagcagagtaagcccccaggtccctcaggagccagcacatctgcagctgtggatcatcccccactaccccagacctcatcatcaactccatccaacacttcgtttactccgaatcaggaaacccaggcccaacggcaggtggatgcaagaagaaatgttccccaaaacgacccagtgacagtggtggtactgaaagcaacagcgccatttaaatacgagtccccagaaaatgggaaaagcacaatgtttcatgctacagtggccagtaagactcaatatttccatgtgaaagtcttcgacatcaacttgaaagagaaatttgtaaggaagaaggtcattaccatatctgattactctgaatgtaaaggagtaatggaaataaaggaagcatcatctgtgtctgactttaatcaaaattttgaggtcccaaacagaattatcgaaatagcaaataaaactcccaagatcagtcaactttacaagcaagcatctggaacaatggtgtatgggttgtttatgttacaaaagaaaagcgtacacaagaagaacacaatttatgaaatacaggataatacaggatccatggatgtagtggggagtggaaaatggcacaatatcaagtgtgagaaaggagataaacttcgactcttctgccttcaactgagaacagttgaccgcaagctgaaactggtgtgtggaagtcacagcttcatcaaggtcatcaaggccaagaaaaacaaggaaggaccaatgaatgttaattgaaatatgaaagctgaaatgcaacaaacaacttccgcttaaaacaattaagttgttaataactgtgattttgtaaatttcagtaattcatttaaatgatgtttcagtagatatattctagcatattaagagcttttataactgagttatagattagtttgctttctggaataaaattttcttcttatactcttccttttttttagatattacattttgcttttatgacattcacgaggcaaaaaaccg

SEQ ID NO: 619 - DNA, 4865 bp, Homo sapiens
gcagtgccgccttttttttttttttgcatcccatttttttaaatttgcaattttatattttgcaaatattttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggccgcagcctcggccccggcgcgcccccggcagctctcggcgcgatgagcatagagacgctactggaggcggcccgcttcctggaatggcaagcgcagcaacaacagagagcacgtgaggagcaggagcggcttcgcttggagcaggagcgagagcaggaacagaagaaggccaatagcctggccaggctggcacatacccttcctgtggaggaaccccgcatggaggcgccacccctgcctctgtctccaccggctcccccgccggcacccccaccaccacttgccacccctgccccactgactgtcatccctatccctgtggtgaccaactcccctcagcctctacccccacccccacccttgcccgcggcagcccagcctctgcccctggcgcctcgtcagccggccctggttggcgcccccggactcagcattaaggagcctgcccccctgcccagcaggccgcaggtgcccacccctgctcccctactgccggactcgaaggccaccattccacccaatggcagccccaagcctttgcagcccctccccacgcctgtcctgaccatagcgccacaccctggagtccagcctcagctggccccccagcagccgcccccacccacgctggggaccctgaagttggcaccagctgaagaagtcaaatccagtgaacagaagaagaggcccggggggatcggaaccagagaagtccacaacaaattggagaagaacaggagggcccatctgaaagagtgctttgagaccctgaagcggaacatccccaacgtggatgacaagaagacgtccaatctgagcgtgctgcggacggcgctgcggtacatccagtccctgaagaggaaggagaaggaatatgagcatgaaatggagcggctggcacgtgagaagattgccacgcagcagcggctggcagagctcaagcacgagctgagccagtggatggacgtactggagattgaccgcgtgctgcggcagacgggccagcccgaggatgaccaggcctccacctccaccgcctctgagggtgaggacaacatagacgaggatatggaggaggaccgggcgggcctgggcccacctaagctgagccatcgtccccagccggagctgctgaagtccaccctgccaccccccagcaccacccctgcgcctctgcctccacacccacaccctcacccccactccgtggccctacctcctgcccacctccccgtgcagcagcagcagccacagcagaagacccctctgccagcccctcctcccccaccggctgcccctgcccagacactggtgccagctccagcccatctggtggcgacggctgggggtggctccacggtcatcgcccacacagccaccactcacgcttcagtcatccagactgtgaaccacgttctgcaggggccaggcggcaagcacatcgcccacatcgccccctcggcccccagccctgcggtgcaactggcgcctgccacaccccccattgggcacatcactgtgcaccctgccaccctcaaccatgtggcccacctgggctcccagctgcccttgtacccgcagcccgtggcagtgagccacatcgcccacaccctctcgcaccagcaagtcaacggcacggccggcctggggcccccggctactgtcatggcaaagccggccgtgggggctcaggtggtgcaccacccccagctggtgggccagaccgtgctcaaccctgtgaccatggtcaccatgccctccttcccagtcagcacactcaagctggcttgaggacgaggccactcagaggcccccagtggggacagggagggggacctgtcccccactctctcacccaccagctccacacattccagccaggcccaggccagcccccccacccacccccaggcctcctaggggaagggggtgcaaagactctgagccaagggagggaagggccaccctgctgcactaggacttggtaagatgactctgagaaaatgcgagactctgatggaatgtgccacctgtccggcccagtgccagctccagtgccgctcctgcttcccctccctaccctcggaaatcagtgcgatgtggacgtcacgctccctgacttctcccccgccctgccccgccttcgtgtgctgctgctgctattgctgtctggtgaggtggcccaggcccccggctttcctccggagcctcatgttctcttcccaggcctttggaggggaaatggggaaagcagaactgaagccacttggcccagaaagctgcggattggggtgataaggggccttgctctgagcacaggtgacagatcataggaagtggctggtctggagtcccacccggacaggtggggcctcagcctggggctctctgacccggttgcagtcactgtgattcgttaccgtagatactacttaaaatgattctctaccaacaataaaccaaacccagccactgccaagcttcctgtgccctcaccccaatccctgccactgggctctggacctcaggagggcaggctgaggtggggaaggagggacttggctgtccttccccttccccgtcccctgcagcctgggtctggatgggaggagagccactgggcccctgtccccagtccccagtccccagccctgggcttggctcttggcttccagaaggcagcaaagaggggcgctgtcctgcgttcagcccctgatctctgacctctgctgagtgctgggcactgctccaagggacaggtgggcctggcggcctgtgggtttgggtgcctcctgcagtttgggagacatggaccagcatctggtcttgtttccaggagcatagaagccacatcgttgagacatcaggaaggtaaaaacccagcggcttagccaagccctaagcctgtccccagaccaaccctgggacctatacagaacagagggccagagctagggctgctgcttctgctccagcccctttgcctctgtcctcccatcccctcaacaccctgcttctcccggggacgcttttgagtgggccctgcccggggagctgcagagcagcagcacctttctctgagaagaggtccttggttgggtcaaggacagggctgagcgtggaagggggaggagtcaggggctctgtgttaggatgcggctttctctgcctctgggcagcctgctttggcctttccttgtatgtgggtgtttattacaagtggctttgtgtcagacacgctcggctccccacctggacacacactcaccagtggcctttcagtgtagcgggaggaagccggtgtccctggatgtgaagctcacactgatgggctggggcaggggcctgggccggcgagggggccggggggaggggacagagctgaggatttcctggagtgccctgcaggcacagaggaggtcagcaaaggtcttgaatagattttctctggaaataaagaatccttagatgcctaaaaattcccttcctgttccctcctggtcctggacacctcccaggggactgttccttatttctctctcctggtgtgggtaaagggacagttacaaaccaggtcaccatcctcagaggctgagccctgtacccaccccagcacagccacctccgccagaccccgtggctctgggagagccagctttgctattcccattgtgacagcgatggcaggcctgacccacggggcagttagagcagcctcgtggagctcgcccctcccctcagcctgcccacctctccctgcatcctgaggccagtggcccccgggcctgcacagatacctcatcatccacccgctgcccctccccgtccctgtcccccagcatcgggggcctgcaaatctagtgccgaatgactatgtccagattggtgacgatgggtgttgctgtttttcttgtcgtttgtgaacgctgtgatgctgtgtgcccaagtgggcagtcaccacccagcccttccttgggcgtctcccccagagtgctgtcgggaccacatctgtcctcaccctgtgggaccgcctggccctccctccctagcccttccagcctgggacacacacacacacacacacacacacacacgcacgcacacgcacacatcttacctctcatgcgtgttttaccttttgatgttcagagtggctcactggctgggagtccttacctcggggagagggggaggttggttccttggggggccaaagaaggcagggaatgcctggagggtaactggggggccaccatgaccccttctctctccagaaacagctgcttctccccccatcccagggtcccacccccaacccccagaggtggcccttgtttacagtgaggactcggccactgtgtctctgtttcctgaaatataaactgtagcgaccccagactgtagagatttttatgtgtttggatacatctgctgtgtggaaaaaaaaaaaaactacaaaaaccctaattttgtacatactgtatttttactattgaactgtattctagtggctgttcatgctccaagactttagttaccgagacatgaatactatccatgtaataagcacttgcctggaataaaatataaaactgaaataaacctgcactgaaacctgagatggagctgccaaaaaaaaaaaaaaaaaaaaaaaa

SEQ ID NO: 620 - DNA, 5400 bp, Homo sapiens
atggccgccgacgtcttcatgtgctccccgcgccggcctcgcagccggggccgccaggtgctgctcaagccccaggtgtccgaggacgacgacgactcggacacggatgagccgtccccgccgcccgcctccggcgcggccaccccggcccgggcccacgcgagcgccgcgccaccgccgcctcgggccgggccgggccgcgaggaacctccgcgccgccagcagatcatccacagcggccacttcatggtgtcgtcgccgcaccgagagcacccgcccaagaagggctacgatttcgacacggtcaacaaacagacgtgccagacctacagcttcggcaagactagctcctgccacctgtccatcgacgcctcgctcaccaagctcttcgagtgcatgactttggcctacagtgggaagttggtgtctccaaagtggaagaatttcaagggcctgaagctacagtggagagacaagatccggctcaataatgccatctggcgggcctggtacatgcagtatctggagaagcgcaagaatcctgtgtgccactttgtgacacccctggacggctctgtggacgtagacgagcaccgccggccggaggccatcaccacggaagggaagtactggaagagccgcatcgagattgtgatccgggagtatcacaagtggagaacctacttcaagaaaaggctacagcagcacaaggatgaggacctctccagcctggtccaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaatagcacatctgggaaatgcagacatgatccagccgggactgattcctttgcagcctaacctggacttcatggacacctttgagcctttccaggacctcttctcttctagccgctccatttttggctccatgctacctgcatctgcctcagcacctgtaccagatcccaacaacccacctgcacaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaaaaaaaaaaaaaaaaaaaaaaaa

SEQ ID NO: 621 - DNA, 8550 bp, Homo sapiens
caacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccagatttgcctgaagacctggataatctccatttttgtcatggactgttaaaacgtttgaagttccaattctggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatatctataccactcagggacagtctcgcaaaaagggacacccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttttcttttggactttgatcttcatttgcaaagagatcccgcacaaatatccagctgcctcactcgcacagtctgtagaaacatccctccaagcctcgcaccagggtagcaaacttcctttttataaagattcataccaaaaaaagcacccaatttgggattgtatgtttgaaaaatcattttctttttaaaaagtgtgaacgttttgctctgttgtgaatgattaattgtatgttttctttagagtctaaagtttagaccc

SEQ ID NO: 622 - DNA, 708 bp, Homo sapiens
atgagatgggctgccccaggaaagaagacatctggtctgcaacagaaaaatattgaagtgaaaacaaaaaagaacaaacagaaaacacctggaaatggagatggtggcagtaccagtgagactccccagcctcctcgaaagaaaagggcccaggtagatcctactgttgaaaatgaggaaacattcatgaacagagttgaagttaaagtaaagattcctgaagagctaaaaccatggcttgttgatgactgggacttaattaccaggcaaaaacagctcttctatcttcctgccgagaagaatgtggattccattcttgaggactatgcaaattacaagaaatctcatggaaacacagataataaggagtatgcagttaatgaagttgtggcagggataaaagaatacttcaacctaatgttgggcacccagctactcaacaaatttgagagaccacagtatgccgaaattcttgcagattgtcccgatgcacccatgtcccaggtgtatggagtgccacatctcctgagattatctgtacaaattggagcaatgttggcctatacacctctgaatgagaagagccttgctttattactcaattatcttcacgatttcctaaagtacctggcaaagaattctgcaactttgtttagtgccagcgattatgaagtggctcttcctgagtaccatcggaaagctgtgtga

SEQ ID NO: 623 - DNA, 1852 bp, Homo sapiens
gtcgttggctggagcagcggctgcgcgggtcgcggtgctgtgaggtctgcgggcgctggcaaatccggcccaggatgtagagctggcagtgcctgacggcgcgtctgacgcggagttgggtggggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgctgaaattcttgcagatcatcccgatgcacccatgtcccaggtgtatggagcgccacatctcctgagattatttgtacgaattggagcaatgttggcttatacacctctggatgagaagagccttgctttattactcaattatcttcacgatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaagggggtaatagctccttttttcttctttctttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaaaaaaaaaaaaaaaaaaaaaaaaaaaa

SEQ ID NO: 624 - DNA, 1998 bp, Homo sapiens
ttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaaaaaaaaaaaaaaa

SEQ ID NO: 625 - DNA, 2440 bp, Homo sapiens
cggacagccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggagttaacctgtggaagatctacaaagcagtggagaagctgggggcctatgagctggtaaggaaggcacctcccagtccttgccaaactgcatatccctggggtgagcctgcagcgctgtccttgcctctggacagaggaagagccaggatccccagtcctacccctgcgtccctgcctccctgccttccccgctggtactctgctgctcaaagcagcttttcagccttccccatctgttctgcccgccccgtgttgggaaaactgcttgggccagcagtccatggccctaggagagagaatcggctggccgctgctggagccgcagagcagctgccaaactgcagtccttcgagtccctgcgagggcggccggagctgcaaggaccccgccgccagggggcgcccgccggccgcgccctcacgaggtgcccttgcaggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccaaaaaaaaaaaaaaaaaaaaaaaaaaaaaaaaaaaaa

SEQ ID NO: 626 - DNA, 926 bp, Homo sapiens
ggggagagccctccctgccagtctggcaactccagcaaagtcctcaggctcatcccacacactcggtgctagtcactgctgtgtgtttacatgagtaatggagctgccgggggaggggagttgtaagcagagcgctgagcctcgcagctcgcattcggagggaagctgacatccacaccaagtcgagacttccagggatgtggccggggagcagtcacatgctgtagctttcatgagcacaggcatcagtcaggcagatgtttgtcgactggaatggcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactatgtttcaagctgctcaaaaactgggaggatatgaaacaataacagcccgccgtcagtggaaacatatttatgatgaattaggcggtaatcctgggagcaccagcgctgccacttgtacccgcagacattatgaaagatcaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaaacaaaaaaaaaaaaaaaaaaaaaaaaaaaaa

SEQ ID NO: 627 - DNA, 2404 bp, Homo sapiens
caaaaaacccaggctccaagggattatgacaactaagattcctcttactggagcaagaactaccccataggctggaaaaatagcttcatgaagtttaagaacaagcaggaacatgggagaaatgaggaattccagttcctatcttgtaaaaatgctttcatatgtgacctgagggaccaggagaggtgaagggagcccctggttctcttataaaatctctaagtttttacaccacttcaagaaatatagtcagccctctttgtatagagcattaggaagcaagagcgtggtgaagctgacatttctcaggcacattgacatttaaaatacaaacttttctcttaaagatctcactggttggacatctcttctcctccgtccttcccttcgctctacttttgttccaagccgcccctgcctctccagggctaggagtgggacaggggtgggagaggtggtctcaccaggctgctggccccacggagcctgtctccctggggatgggaacggggatagaagacaggggaggaggcgcgcgcccgttttgggggttccgggtaggctgtgaggaccgcttttggtgagagtgccttgagcagcggggagcagttggattcaacttcagggcacaggagaagttaggagaagagggagagggaaagagtgggacacacagaaccagggtgcccagccaggcgagggtccgaggcaggaacgttctagcctcttcccgtgcgagtcctgctgcctctttgagcctccgtgtcttcatcactgaggaagggatttgacctgatgagaggaaggtgcccctggcttcccagtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacggaaaaaaaaaaaaaaaaag

SEQ ID NO: 628 - DNA, 7986 bp, Homo sapiens
ggaagtgacgttaggggaaggtgggggcaatcatggtgccgctggggaggggagaagctgctgctgccgccgttgccgggagccgcggagacaagtcattacgttttcatttctcacaactgggctgagcacaactgaaccatgggggaacacagtccagacaacaacatcatctactttgaggcagaggaagatgagctgacccccgatgataaaatgctcaggtttgtggataaaaacggactggtgccttcctcatctggaactgtttatgataggaccactgttcttattgagcaggaccctggcactttggaggatgaagatgacgacggacagtgcggagaacacttgccttttctagtagggggtgaagagggctttcacctgatagatcatgaagcaatgtcccagggttatgtgcagcacattatctcaccagatcagattcatttgacaataaaccctggttccacacccatgccaagaaatattgaaggtgcaaccctcactctgcagtcggaatgtccggaaacaaaacgtaaagaagtaaagcggtaccaatgtacctttgagggctgtccccgcacctacagcacagcaggcaacctgcgaacccaccagaagactcaccgaggagagtacacctttgtctgtaatcaggagggctgtggcaaagccttccttacctcttacagcctcaggatccacgtgcgagtgcacacgaaggagaagccatttgagtgtgacgtgcagggctgtgagaaggcattcaacacactgtacaggctgaaagcacatcagaggcttcacacagggaaaacgtttaactgtgaatctgaaggctgcagcaaatacttcaccacactcagtgatctgaggaagcacattcgaactcatacaggggaaaagccatttcggtgcgatcacgatggctgtggaaaagcatttgcagcaagccaccaccttaaaactcacgttcgtacacatactggtgaaagacccttcttctgccccagtaatggctgtgagaaaacattcagcactcaatacagtctcaaaagtcacatgaaaggtcatgataacaaaggacactcatacaatgcacttccacaacacaatggatcagaggatacaaatcactcactttgtctaagtgacttgagccttctgtccacagattctgaattgcgagaaaattccagtacgacccagggccaggacctcagcacaatttcaccagcaatcatctttgaatcaatgttccagaattcagatgatacggcaattcaggaagatcctcaacagacagcttccttgactgaaagttttaatggtgatgcagagtcagtcagtgatgttccgccatccacaggaaattcagcatctttatctcttccacttgtactgcaacctggcctctccgagccaccccagcctctactacctgcctcagctccgtctgctcctccgcctgctccctccctaggacctggctcccagcaagctgcatttggcaacccccctgctctcttacaacctccagaagtgcctgttccccacagcacacagtttgctgctaatcatcaagagtttcttccgcacccccaggcaccgcagcccattgtaccaggactttctgttgttgctggggcttctgcatcagcagcggcagtggcatcagctgtggcagcaccagccccaccacaaagtactactgagcccctgccagccatggtccagactctgcccctgggtgccaactctgtcctaactaataatcccacaataaccatcaccccaactcccaacacagctatcctgcagtccagcctagtcatgggagaacagaacttacaatggatattaaatggtgccaccagttctccacaaaaccaagaacaaattcagcaagcatctaaagttgagaaggtgttttttaccactgcagtaccagtagccagtagcccagggagctctgtccagcagattggcctcagtgttcctgtgatcatcatcaaacaagaagaggcatgtcagtgtcagtgtgcatgccgggactctgcaaaggagcgggcatccagcaggagaaagggctgctcctccccaccccctccagagccgagcccccaggctcctgatgggcccagcctgcagctcccagcgcagactttctcttcagcccctgttcccgggtcatcatcctctaccttgccctcctcctgtgagcaaagccgacaagcagagactccttcagaccctcagacagaaacattaagtgccatggatgtgtcagagtttctatccctccagagcctggacaccccgtccaatctgattcccattgaagcactactgcagggggaggaggagatgggcctcaccagcagcttctccaagtgaagggcccatgtgtgctcacctctgggaaaagcgggtgagcaggaggcatgaggtacaatgcctgccatcatgggtcagaaatttgaaggatgaagaaatctactgtttgaaatcctcacctttcagacgtattttctttattcacatcccaggagcatccattttaaggaactattctttggaaaaaaacaaaaaacaaaaaaaacaacaaaaaaagctaagttataagtgaactgtttggctgcactgtatgtcacttttgcttgttgtcatgtgaacttggaaactaaggttactcgtgtgcataaaaattctaaatgaaagggtgtggtttccatcaatctgatgctgcccatcgcttgcactggggtctttgtggatcgggcaggagttttcagtgtgttgggtgttgctccttcctatgtgtcttttgaatctgaggctgacatttgcttggaaggccagacccttgctccatcagagagggcagtggcaaaggccagtgaggcagctgtgagttggacagggttcaggtgagatggtgttgtcatttgtgcttagtgttggtggtgctcagggtggataacacgggtcgttctgcagcccgcttcagcacaaataggcagcttaaggcctggctcacaggctgtggggttgatctggctctgcagaggccctaggcagcttgttgactgctgtctgttgatgacgtgtgtgcaaagcaggctctagcaacatgatcactgtccttgccttcctggttctttctctcggttggttgccagggcttgcagatcgcagtgaattttccttggggaacatcgctgttttgtcctagagtgaacttgtggcttatggccagtgctgtttggtggtctgccttctttttaatggtattttcttcctcagagcagaagggctgcattttgcttatcagaagaaggtgcagatttaagggaattcatatgaggtggcatgtaattggcaggccaggtgtcctggttccaggttccagccaggctttgggttgccccctccatctctgcccccctctggattttgcatacagcctcatacagtgcaaacaaggatgtgacttgctcagcttagtcatgtgatttatttaaaaaaaaaaaaaaaagaaacacaaaacgatgatcttctactcagggtatagcaaaacaaaaaaattccctttccaccaaaaagcctgaaatgttgcaataagttatctcatttggaatgtttcattaagttgtgttataggaaaaaattgtgtgtgtgtgttatagaattatatccatatgtctgcctttggctccaagtcattgcctcttaaaataaaagatacaatccatactagcatgaaaagtttccctcaacaggctatattaacatagtcatgagtgctgaccaaactcaccgagctcagaggccaggcatggcctgaggtgcagaataggcctctgcctcccaagagccctttccttgccctgagcaaggagtggtgttccacaaacaaggctgctcttctaagccaacagtgtcaggcaggaagcagccataattttgccttgcattttcattccctaatgtaaagggatctgcattggtcactctcctgttctctgagccattgctcagggccagccaagatattattgagaacagataatttaccttggagccagaggccctccctgcctttagcaaggatgttcagggacagacaaagagggcagtggtggtgaatgttgttactgccatgaggagaaatggcagtaagaaatcttaactacaagcagccaatttctcattccaggaccctagccagaataattgacttctttttttttttgagacagagttttgcttttgttgccctggctggagtgcagtggcgcaatcttggctcaccgcaacctccacttcccaggttcaagcaattctgcctcagcctcccgagtagctgggattacaggcatgcgccaccacgcctggctaattttgtatttttagtagagacggggtttctccatgttggtcaggctggtctcgaactcccaacgtcaggtgatcctcccgcctcagtctcccaaagtgctgggattacaggtgtgagccaccatgcctggtctagggaattgacttctttttgaccttctgcactcccttccccaaaaggattgtggcttctgttgaccattgacctcagcagaagttgataaggcaggaggtttccagtcctcctggaaaaccaactgctgagcatgagttgtccttggctgtctctgggcctcgcacccatgggaagttttgaggtagggcccttgctgtttacaacttctgagagagtagtgatgggaccccaaagtaagcttgtatcagagggcagtaatgaccttcccatatccccatcctgtggtcacctgggatttgggttccctggggcggaagtgggaaataggagcccagggaaggacatctgaagcacccacagtttaaatagcgactcttcttggttagccagggctgtgctcatgttgggccctacccaggtcagtggccttttcactctcaaagatcgggggtgacgaagcagcatcttaaacagtgtttaggctgacagatttttccagttgaagaagctgaagtatctgccttttgagggtgactctagattacaagagagactatcagatccaatcagcttttgaaaaatcaggaatgtgcttaaaatgccagtgagtggttgtgaagatcaggtttatttcccaggataggcagtctttctttccctccttttccagttctcttttcctacctgtccttccataagcctggtctctagtgccgaggaccttggagaagagagggcccctagctaagctggagccagaaagaaccttcatggtgagtgtggtttcccaaacttgggaaatgaacctagggtgaggttagggaggatttgtagaattctagcaggtaaaaatcaagcctttttcccctcccatagtaaacttaaccattttcaccctgtacgttatcttctagctcctactaacatctccaattagacaaccgcttcaaagggtgcttagcaccagggattggggttcatggacttaggaggtggtaaggaaactggctggcaccaccaaactgccttagtgaacttggcccttcccaggcaggtaggttgggcattgagggaaggtggcccagtctttgctggcagggtctggccagtctcatgggggcaccaccagtttggtgacagaagtggtgtcatttattgaattccacctccgtttagaaggagatcatggtacaaagcccaggaggggccttaagatgtgaagatctctctgagtaaaaggcaaggggcttctcttcttcacctctgggatagttggtagatcggagagttttattttcagggtcaaggctgtggactgatggggatattggagggtgggtgggttttcctgagagactttgtataatgctgaatgtgtccagagggacaagtttgcagaacctcatattggtatattaaagaaataataaaataaaaaagcactttaggttattttatctttaacccgattgctgcaatttcttttgtgtgtatatatacatatatatactttccacaaagttttattttttgctcagaataaaaagttaaattgaggtgtgaaaagaaaagcacttaccttggtgcaatatgtgtagcttgatggtcgttgtcccatgtggccctggcctggcagcgtttttccgctcaatcagccctgtgctgtgagactgtccatagggaaacactattatgcattctcagcaaccgctcaatctatgcaagccttccctgtgtgccccagggcgccccctcaggctctctgaagaactgctgtgggtcctgttttctgctgactgttgaggccctttttcatcacttcttggtctctcgccatcttttccctcttcaccattacaaaatgatgcctgaaaggaaggaacagattgttcctaggtagaaacctggcaccttctagacttttatatttgtaatcacatccattgtccttaaagacttttccagagtgattgaaaccattgatttgtggaactgcaacaatatttctcaagagtttacaattgtcttacaccaccaatcagaaatatgtttggggaggcatgggtggcagggggcaacatgagccatttccatactgctccccatactacctgtgttggttccttaagcaaaaaggcctccagccttcattaaatcctataaacaaacattacatcccatgaatcattatcaactttcttcctttactccacctcccccattttatcttcaattctcaggctatagaatagacaagttttagaatatacttcagccaaagcagaaggattttcatagatccaatatgcaaatagttctgctgtgacatagatcagaaattgtctgttccttaatatttgggggtggaggcaacaaaactgaagcatatttctgattggttagccattttggcctgtttcctcttgcatgttttttagggagagagggaaacagtcctgtatttcttctgatgccctttggggaagccgacgaccactgggcatttctcactgttactcctgttcaagagagggcttctcagtctgcactgaaaaatgcaaattaaactggatctttatgtcaatgtgtacatagtacaagcttttttactggaattgaggtttaaaaccacacactgcccttttggtggtgtgcctgttgggccaaaaattgggtgataatgtagtgtcactttctcagctcaatgcagtttctactttttcttatgggaaaatttttcataaaacctttttgcaccaaaacccaggggtgttttttgcaatatccttgttatcctcgtagtgtgccaagtcagaggctttctcttgcccttttcctgctgtgttctcaggcctcccaagggctatttgactcaacagtctacatccttcgttgtgttttggagaatgtgggggtgggggtcagagttcaaggtgtctgttcccttttcctgtgaactctttctagtccctatttggggagggtggctggaaacagatttttgctgaatttctggctcagatcttctagccaggaaaggcaagagcccccaagagcccttttttttgacatacactaatcattggccggggtcttggtgacaacttttaaaatcccaaatagttttatttggattatgtaaaagtaagtgtgaaacatgggaacaacggacttccactgagcgatgtgaaaacgttacaggttcagtacttccaaaggaagaaacctccaaacccaaaaaagaataaatatgaatttgtatttttgaagaatgtgaaataatggtgtttgcttaattgctcattttgtataaacttaatattgtactttaaaatatctgctaaaaagtgaaaatttaactttttggaattgaaaaagcaatattaaatactaatgaaatcctaattaaatgcttatttaaatctggtaaaaaaaaaaaaaaa

SEQ ID NO: 629 - DNA, 1483 bp, Homo sapiens
ccgcggcacccacgtgcagcggctgggcccggcgctttcaggggaccaccaggcccccagagcgccgtgctatgttgggggctagtcactagcacggggctggaagctgagatcaaagacgccaatgagccggcgtgggtggatgagtgaggcgggcaagaagcagcaccggttagcctgagggttcgctccagggccaggcctggagccagcgcccttacctgcccctggaaagtctgagaccactcggggcggggcggctgccggagggtgggctgcggctccgtggcgggttccagaggggcggagccaagggctgggcgttcccgcgggcggggcgtcccgggggcggggcgggcccctgtgtttgttgcaccgtgtcagttactttgtaacaaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcaggcctctcctctgagcgctcagactcagaccaagaggagctggaggtggatgtggagagcctggtgtttgggggtgaggccgagctgctgcggggcttcgtcgccggccaggagcacagctactcgcacggcggcggcgcctggctatgatgttcctcacccagggcgggcctctgccctctactcgtgccaggcccacttgccaggcaggagccctccccaagccttcagggctgctcggagtcacctgttggaatggactaaaaggacccttgtgtgggaacaggtgctccccaaacaccctgctgctggctgccaggcaggccctctggaagggaaggggcaggactcatcaggacctccctggacccctgcagggcaggcagcttgggcccgagcccaagcatttggctctgctgcccccaaggggacaggaagcctcttgggcctcttcccttcctggacaaggccccctgcctttgcctcacataaactgtacagtattttcattaaaagcctctttcataacttccaaaaaaaaaaaaaaaaaa

SEQ ID NO: 630 - DNA, 3773 bp, Homo sapiens
ccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggtcttcacacaacgagctagaaaagcacagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctc

SEQ ID NO: 631 - DNA, 3272 bp, Homo sapiens
cacgcgcgggctgcccgcggcacggcgggcgcggctggcgcggctggggcggcaggggcggcggagagcgcgccgagccgcggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaa

SEQ ID NO: 632 - DNA, 3342 bp, Homo sapiens
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacctaaaaaaaaaaaaaaaaaaaaaaaaaaaaa

SEQ ID NO: 633 - DNA, 4585 bp, Homo sapiens
ctgacctggaagcggctggggccggagcacacgtgtttcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggccgaaggggtccgagatgaaatatgccctgaagcgtctaatcacgggactcggggtcgggcgagaaacagcccggccctgctacagtttggccctggcacagctgttacagtcttttgaagacctccccttgtgcagcatcctgcagcagatacaagaaaaatatgacctgcatcaggtgaagaaggcaatgctgagacctgctctctttgcaaacctgtttggagtgctcgccctctttcagtcaggtcggctggtgaaggaccaggaggcactgatgaagtcggtgaagctgctgcaggccctggcccagtaccaaaaccacttgcaggagcagccccggaaggccctggtggacatcctctccgaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggctggtgaatgtgctgaagatggccgcctcctctgtgaagaaggaccgcaagctgcccgccattgctctggacctgctccgcctggcactcaaggaagacaagttcccacggttctggaaggaggtggtggaacaagggctgctgaagatgcagttctggccagccagctacctgtgtttccgcctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaagtcccctgcagagagctgtgacctgctgggtgacatccagacctgcatcaggaaaagtctgggagagaagccccgccggagccgcaccaagaccatcgacccccaggaacccccgtgggtagaggtgctggtggagatcttgctggccctgttggcccagcccagccacctcatgcgccaggtggcccggagcgtgtttggccacatctgctcccacctgaccccgcgtgccctgcagctaattctggatgtgctgaaccccgagaccagtgaggatgagaatgaccgtgtggtggtgacggacgattctgatgagcggcggctgaagggtgcagaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctgggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgctggacctggtggaggtgctagtgaccaagcagcccgagaatgccctggtcctggagctgctggagccgctgctgagcatcatccggcgcagcctgcgcagcagcagctccaaacaggagcaggaccttctgcacaagacggcgcgcatcttcacgcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggctgccagctgcttggacttgaacctggtgacccgggtgtactcgacagcactgagctccttcctgaccaagcgcaacagccccctcacagttcccatgttcctcagcctcttctcccggcacccggtgctctgtcagagcctgctccccatcctggtccagcatatcacgggcccggtgcggccccgtcatcaggcctgcctgctgctccagaagaccctgtccatgcgggaggtgaggtcgtgctttgaggaccccgagtggaagcagctgatgggccaggtcctagcaaaggtcaccgagaacttgcgcgtgctgggggaggcgcagaccaaggcgcagcatcagcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaaaaccagaagccgtcccaggtgaatggagctcccgggtcccccacggaacctgcaggccaaaagcagcatcagaaggctcttcccaaaaagggggtcttgggcaaatcaccactgtccgcgctggcacggaaaaaggcaaggctgtctttggtcatcaggagtcccagcctgcttcagagtggggccaagaagaaagcacaggtgaggaaggcagggaagccctgagcacaggtacgggcccccctcagcccctgcctccatctgcctgagacgcctattttttttttttttttttaaaccatgattttaatacgcaagctgtttctaaggcgctgccactggggagggtggctgttgccgcctgcccgggcatcctgctctggcaagcacagcctgagccattcctgcaggggtcccagggtgcagagacctccccacccccggttctgggctgggaccctggctccagggccatgtccagggctctggtgtttgcctgggttggtgcaggttgatgtgctggctgcaggcaggtgtgaccatctctcgtgcctgccacctctttgcccccaggcttttttgctgtgagggagccaccagggggtgatttaaataggtttatttcttcatttacaagaggaatatatttggcttctctcttaagactctgagattcacaatcagcagctctaaaaaataaaggagcagtttggcttccggaaggaagaggaggcaacactcggaaaaaaaaaaaaaaaaaa

SEQ ID NO: 634 - DNA, 3587 bp, Homo sapiens
gaattcagcacaatgaaggagccatggaatgccaatttaacgtcagtcttgtacttgaagggaaaaaaaacacttgtaatggtggcaacagtgaagctgttcctttaacatccccaaatatagccaagtttagcactccaccagccatcctcagaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtcagaaaatagatttactacatccttattaatgataccattattggaaatacatgacaataggtgcaacttgattcctgaaaaacaagatataaattcaaccaacaaaacatatacacttactaaaaagaaaccaaaccctaacacttccaaagttgtcaaattggaaaagaatcttcagtcaaattgtgaatgggaaacagtggtttatgggaagacagaagaccaacttattatgactgaacaagcaagaagatatctgagtacttacacagctaccagtagtacttcaagagctctcatactgtaattgttattaaaattgatgaaatgccccactcccttactgcagtctctactaaattaggttgcagtgaaatttttctcaattagttgtttttaaagttgtaagatacccttttaatacagcatcttttttctattctatatagtaggcagaaagctagtaagtcacttaaggggtagatagtttcatagtttattttttaagagatgagatttttaaaaattgtttttaaagaacaagatgggaaaataatagaatgttcatggatttctaaaagtaaattctcatatattttcttcacaagatatatgttgctactctcttgatgctgcagttttgttatagataggtgtatgagtatatatgatttctgaaattagtctatgtatggaaagcacacatgattttatgaaggtacttttgcccatgtgctgatttacttaggctaccatttacaaagaaacacattgaaaaggaatttaaaggaaggatagaaagttgcactactaattttttgttttttttttcagaagcagtaaaattaactacagtgttaaatgtatttatttgagcatagtactgaaaacaaaaagcattcaaaaaagagttttttctttattagtaaatagtattttcttaatctcagaggagctgagagttttgttgaatgtattgtacagtatgtaggagcaggagaactttgtaaattggaaagaagtctgtttttataatttatttttatttttaaagcttaaatgtagatatttatagtatacagggagcctagaagccaatgttgtttcctgttattacagctaacacagtaaagaataattttgactttaagtatgaaacagtagtaagttatagctgcaaagaatacaatatctatactgtatgtcacatctacctaaatgttgcactatgccctttaaatcatgctggttataaagtagttctaaaaatgtactaaataataatttaatattttctttttaaattatatcgggggtggtcatatacattaatctggtgatttgtatatgtgtttgaaattttttgcttttgtttaaaaaaaaataatatggtaccttggtccctaaaaacagtctgcacttagaagttatatttactcagtgtttcagaagtggagaacttatcttttatttataaaaatattttgtccttttttaaatgttttgtgtttctctacaggttacaacagttgcttcagttgcctgttttaggtgtttgcacttattttatttcttcttgaaagaatttttatttgcttttgtggtagagattatatgtaattttttttcagtcatataatggtgtgctgtcaacttaaacactgacaggtaaatagaattgtacactgtagtttgaattatttataattgacacactctctccctctccactcctgaagtatgctgctatagaaaatagcagaatcggcttgctgctacgagagaaggaaagagcgaccaccacttgcactgtgtgaaaagataaaaaacaaatgatggcaagttctcaagttaactaaatggaatcaaccattaccaggcaaattcttgcaaataccaaaatactactatgccttataaaacaaaatgaaagcaggttaagattttctgctctgtttgtatgttaatagaaatggaaatactaagtattttaatgcttagctattgaacagtagacctaaaagggttttaagctatttaaatctacttgctagtttttgcatattttatatatatatatatttatatatatatatagtgagaagtgaagaaaatgtatggtactaagattatgccttattgataaatagataaaccaatttgaatcctcttagcatgtttaagtatgttgattgctttctaattaatgaacttctcacagaaatttcacttagtgaaaccaatgattgtagcaaactcatactggatcatttcagttaccttgaactaatagcacataatggttttttgttgttgttgtttttaatgtagcccttacctggatatacatagtctgcaatcaccaaagtataatatcttgtaaggctatattttttaaagcatattttttcttgagcattaaattatcctaaatggtaatatattgtggataagtctgggcttattggacataatacatatttgggttggtactggttgaatccttcagttaactgctttgttgctttttgcaagattttttatcttaaacatgtcaggcatcttaagtcacctttatactgttttgttcctctgagtttctttcagtatgttatacaaatgccagacataacatgtagcagccatacttgcatggaaactgactacacatacataatactgcattttattgtaaggttttcacattaatacagcaattaccctgactaaattgagttttgtgatatatggaaaacttcattgtaagagaatcttgcatacaatgttgactattaacatccaaaataaagcatctgtgtacaag

SEQ ID NO: 635 - DNA, 2731 bp, Homo sapiens
gcgcttggcgggagatagaaaagtgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttaaaaaaaaaaaaaaaaaa

SEQ ID NO: 636 - DNA, 2379 bp, Homo sapiens
gacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaaaaaaaaaaaaaaa

SEQ ID NO: 637 - DNA, 2093 bp, Homo sapiens
gcgcatgagcagtgctgctcccaacccgccagtcgcggtctccggcgccagctacgccgctgccgctgtcactatggcccattacaaagccgccgactcgaagcgtgagcagttccggaggtacttggagaagtcgggggtgctggacacgctgaccaaggtgttggtagccttatatgaagaaccagagaaacctaacagtgctttggattttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggtcttaaagcaggagaatccaaagtaaatcctgaacaaaacctaaacacagccatctaactcattaccttaaaagacattctgtttattagtctgattaggaatgatggcactggttgtattttagccaagacagtttagcatggagctattccttggtgcagttcaggatatgaacacaggtacagtcattctttgaaggtgacactgttctgtatattccctataggcagctggagagatctgtgtgacacaagatgcttttgtacgggttcccatgaatcttctgctcttgtttgtgtgacatggaacaaataacttctttgccaccactttgccttagataactgtgtgtgtgtgtgccagtttgaactctgacaccacattttccttctatgcaatcatgcctgtctgataatcttgcattgctttcctctgagctttagtgggtcctagttgcacactggcctttctgtgctgtttttcaatttgcctaataatagcagttaccctgattgtaatttatgtaactttaaacaggatcacactgtaccccctgcctgccttatttgcttactgagcacaggacagaggcaatatacaactctgggttcacacacaagctgagatgagaagaggaatgagccatatattggggaaaatcatagtttgtaggtataattatatagtgcttttctccctcaaagtatttttctagccttgaattcattttatcttcattatccctgtgaagtaggtgggacaagtataaggggaagaggggtgctgaatttttaggccaaagactgatattaatacaaatcactcactaactgtagagccttgggcattatcagtgaactactctgagatttactgtcttcatctgtttaatgagtagaatgtccgtgatgcctacctcacagggttgttgtgagggtcaaatgagaatgtatgtgaaagatttgtaaatggtaaagcactatattcttgtttgttagtcctttttcctttctttgggtagacctacagtcagatgttttgttttatggatcacttattttccttactggtagactgtcgttttatagacatattcctatttcatatattctctccctgttgttagagaacctatctttgtttttggtcaaaacacacatagaaaacaaaatgatccaatgaaaactggtttaactagcaaaagccttggcacctgttggagactatgaccaagccaataaaaagggcatttaaatcagccctgttagtaggaatgtggctatggctggtgcctcttctagtcacaagtttgtttttggagggggtccagaagatcattcccttgcatagatttctcttttaccaatttgagtgcctcctacatgggcagcagtggactaagtgctgggtgtgataaagaggaatgacttaattatgagactgtatataatcaaatacagtgtgggttaggacctgtggcagaccattataataaagcatggccccgtgagggttttgaaagagaaa

SEQ ID NO: 638 - DNA, 7011 bp, Homo sapiens
cgggccgcatcagccctcctcctgtttgcgctccccagcgtgcaatttatttggggggctaccggggattgaacggagcgggcgagcgctgccaggaggtggggccggccccacctgtcgactgcccgtagtaggcagggagagggcggggtttgtcccatagggcccgccccccagtccctgggtcccgggcgcgcgacgagatataaggcagtcaggaaacaatgcgcctgcagctcgcgctcccgcgccgatcccgagagcgtccgggccgccgtgcgcgagcgagggagggcgcgcgcgcggggggggcgcgctcgtgagtgcgggccgcgctctcggcggcgcgcatgtgcgtgtgtgctggctgccgggctgccccgagccggcggggagccggtccgctccaggtggcgggcggctggagcgaggtgaggctgcgggtggccagggcacgggcgcgggtcccgcggtgcgggctggctgcaggctgccttctgggcacggcgcgcccccgcccggccccgccgggccctgggagctgcgctccgggcggcgctggcaaagtttgctttgaactcgctgcccacagtcgggtccgcgcgctgcgattggcttcccctaccactctgacccggggcccggcttcccgggacgcgaggactgggcgcaggctgcaagctggtggggttggggaggaacgagagcccggcagccgactgtgccgagggacccggggacacctccttcgcccggccggcacccggtcagcacgtccccccttccctcccgcagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcgggtaaggacctccccgagccatccaagagggggccaccccatgggtggccaaagctctgcccctgcctgaggtcaggcattggctcttctcaagctcttgggccatctccgcctctctttggctgaagctgcccgtgtagtccccaaccgtgtctgtctggcacgtgggtgtgttggtaaacagtttggaaaagtggcgtgggagccagcctccctttgatgattattggagccccaggggacaagggatttgaggtgagggttggcgcttagagaggacaatactggggttggactgtaagggattgaagggggtaccttaagagacactccaaacctgaagtttttttgctgctgcctctttccctaggaaactcacactcccctagggggagaagaagccgagagccttttgtgcaaagccaaaaccttcgtccttttaaaaacctaggtctccagttggctttactttaaaatgccaataataaatgccctcttctcgtgcctccccaccaccacttaccactcgtgcatccctgagacagggagggaagaatgaacactccccattaacagatggaaaaactgaggcttagagatagacaatcactacaagtcagctccagctttctgccatctagccagcccctcttccccaatgctccatcccaaccaggcacctcttccttgatgtttggggtctttgtggtagcttatcttagaagcactacaccttgccttgctgtttgtcctgagatggaaaagtgtccttcttgctccccctcaatagatctccagcgtcagctgctccctggcattcaacaaatattcactggcccctactttgtggcaatctgtgggctacatgctggggtcaaggcagtagaactccaggccctcctctcccatccttgatgcaagtgcaacctcgctgagggcagactggggcatcctgtgccactaaactacattgttcttattctggcatcttagacctccacacccgtgagaaatcctggagagggtatttttgtagagtgtagactgtggctagtgacaaataaattaggaccaagaaagctcactgtagcttttaggaataacttttacacgaccatttgatagggaactggggaatggggtatggaagttttcctacacttgagagaaaaaataggataacaaaaattaaaagtctttttttcctggtccactgtgttaaggtcatttttaaccagcttgctttctacaccaagagtttatgtttgtttaatggctggaaagagaatcttgagatcaaaaaaccaataaagatgtatctctacaacggctggtggagtggtagagtggaaagagcattgctttggaagttggaacattttagtttgagatccagaacgttacaaaggtgatatgtggacttcgctgatctgggcctcagtttccccatttgcacacgatggggttggacttgattgtcctgctgatgacatttccttgtctggatagagtaagacactactctctgaaagggagaatggtgtgcttaaattatttctttcttagatagaatcttcctgagccacgaggcttaacactgaaaattaaaggtttgggatgtaggaaagcctgctgaatcattttctaacctaccctttaacctgaacctgtttgtgagcttctagttcactcacaggccacatggcctggaacaaaatgcaacagattgcaaacaatgaggcggggggtggggaaagtgattggcagcagagctcacccaataggggctaggggctgggtaagacagaattccaaacacagcgtaatcagccaatcatgggctttggggccaggagggctgaatggtcaggtttattaatggagaaataatgcgattgtccacacaatggaagccttcctgacaaaggggctcaagcttcctgatatgcaaagaagctgagaacggagctcttcctttgccgaggccgagatccattaaggtcggacttctgtgtggaggctgcaaaatgtgtggagcaggaggagacttttctcccaattgcccctctcctggttaggttaacctaagagaccttcaagccagtgaatgagaagggcgtgtccaggtgtctccaggtctctggtgttatgagccccatatctgggacattctgctgcccagtctctgcctctggtgcaggtagtttggaaatggtcgcttgtacctttgtgaagttcctgcagcttcgccgacctatgattacaaatctaaccttctagtccagggaaggaggtggggcaggcgacctataaatgatggatgactttagaaacccattgaacccaggagcaaaatgctcctaagggaaaccctttccctcccctctgtgggtgaagagggatgggttgtagccctcccttctctgaatcttcagctgaaagggatggcagaatagagaggtgggggaataataggatttataacttgtgaaaagtaacaattccccaagtgcaggctgtgctgggcaggaacaaagggcagctctgcccacagacccctcatttacaattctgatggggcatgaaagagcccgactggggaagatctttatagctaaactttgtcccaggccggtagctctttctctccaacccctccgtgggggaggggagagcctttgcagactgggggctgttggcttgggtctgccttttgttcttatctaagccttgctgtgcaaaaggaaattggagaatattttccttcttgctaatgtcccctcctttccttcactgtgcccttaccacattacaaatgaatcagctttctgctcacctcgatttgtatatatctaaattggaaaaatgtctcctaccttcccaagcaccagcgtagacagctaaagctgtagggtctatgtttgtgtttctcatgggatgtgtttcttctcttgatctcttttctcggacagagaatgaagaaattgatgttgtgacagtagagaagaggcagtctctgggtattcggaagccggtcaccatcacggtgcgagcagaccccctggatccctgcatgaagcatttccacatctccatccatcagcaacagcacaactatgctgcccgttttcctccagaaagctgctcccaagaagaggcttcagagaggggtccccaagaagaggttctggagagagatgctgcaggggaaaaggaagatgaggaggatgaagagattgtgagtcccccacctgtagaaagtgaggctgcccagtcctgccaccccaaacctgtcagttctgatactgaggatgtgaccaagaggaagaatcacaacttcctggagcgcaagaggcggaatgacctgcgttcgcgattcttggcgctgagggaccaggtgcccaccctggccagctgctccaaggcccccaaagtagtgatcctaagcaaggccttggaatacttgcaagccctggtgggggctgagaagaggatggctacagagaaaagacagctccgatgccggcagcagcagttgcagaaaagaattgcatacctcagtggctactaactgaccaaaaagcctgacagttctgtcttacgaagacacaagtttattttttaacctccctctcccctttagtaatttgcacattttggttatggtgggacagtctggacagtagatcccagaatgcattgcagccggtgcacacacaataaaggcttgcattcttggaaaccttgaaacccagctctccctcttccctgactcatgggagtgctgtatgttctctggcgcctttggcttcccagcaggcagctgactgaggagccttggggtctgcctagctcactagctctgaagaaaaggctgacagatgctatgcaacaggtggtggatgttgtcaggggctccagcctgcatgaaatctcacactctgcatgagctttaggctaggaaaggatgctcccaactggtgtctctggggtgatgcaaggacagctgggcctggatgctctccctgaggctcctttttccagaagacacacgagctgtcttgggtgaagacaagcttgcagacttgatcaacattgaccattacctcactgtcagacactttacagtagccaaggagttggaaacctttatgtattatgatgttagctgacccccttcctcccactcccaatgctgcgaccctgggaacacttaaaaagcttggcctctagattctttgtctcagagccctctgggctctctcctctgagggagggacctttctttcctcacaagggacttttttgttccattatgccttgttatgcaatgggctctacagcaccctttcccacaggtcagaaatatttccccaagacacagggaaatcggtcctagcctggggcctggggatagcttggagtcctggcccatgaacttgatccctgcccaggtgttttccgaggggcacttgaggcccagtcttttctcaaggcaggtgtaagacactcagagggagaactgtactgctgcctctttcccaccttcctcatctcaatccttgagcggcaagtttgaagttcttctggaaccatgcaaatctgtcctcctcatgcaattccaaggagcttgctggctctgcagccacctctgggccccttccagcctgccatgaatcagatatctttcccagaatctgggcgtttctgaagttttggggagagctgttgggactcatccagtgctccagaaggtggacttgcttctggggggttttaaaggagcctccaggagatatgcttagccaaccatgatggattttaccccagctggactcggcagctccaagtggaatccacgtgcagcttctagtctgggaaagtcacccaacctagcagttgtcatgtgggtaacctcaggcacctctaagcctgtcctggaagaaggaccagcagcccctccagaactctgcccaggacagcaggtgcctgctggctctgggtttggaagtttggggtgggtagggggtggtaagtactatatatggctctggaaaaccagctgctacttccaaatctattgtccataatggtttctttctgaggttgcttcttggcctcagaggaccccaggggatgtttggaaatagcctctctacccttctggagcatggtttacaaaagccagctgacttctggaattgtctatggaggacagtttgggtgtaggttactgatgtctcaactgaatagcttgtgttttataagctgctgttggctattatgctgggggagtcttttttttttatattgtatttttgtatgccttttgcaaagtggtgttaactgtttttgtacaaggaaaaaaactcttggggcaatttcctgttgcaagggtctgatttattttgaaaggcaagttcacctgaaattttgtatttagttgtgattactgattgcctgattttaaaatgttgccttctgggacatcttctaataaaagatttctcaaacatgtcagagtgggggcagcttatgccacctgagtcctcctcaaccacggaaaactatttcagggtagccacaagtgatccagagggctgcacttctctaaccatgttgctaacctggtcattccactctgggttcctgaaatgccatttcagacatgttgaaacaatgtaggctcagtactcagtgaacacggaattc

SEQ ID NO: 639 - DNA, 2961 bp, Homo sapiens
tagaaataaacagagggcgggtcgcgcgctcggtggcgcgttgtgcgcgtgtgtggagtgccctgctgcccccagctggaggggaactagtctgctccaggtggcaagctgcgtgagcaagcaagccaacatggaccgcgactcgtaccatcactatttctacgactatgacggcggggaggatttctaccgctccacgacgcccagcgaggacatctggaagaaattcgagttggtgccgccgccctgggacttgggtcccgcagccgggaacccagccctcagctttggtctcctggaaccgtggccggtagggtgcgctggggacgagacggaatcccaggactactggaaagcttgggacgcgaactacgcctccctcatccgccgtgactgcatgtggagcggcttctccacccaggagccgctggagagagcggtgagtgacctgcttgccgttggcgcgccctcgggatactcgcccaaggagttcgccacccccgactacactcccgagctcgaagccggcaacctagcgcccatcttcccctgtttgttgggcgagcccaagatccaggcctgctccaggtctgagagcccaagcgactccgagggtgaagaaatcgacgtgacagtaaagaagaggcagtctttgagtacgcggaagccagtcatcatcgcggtgcgtgcagaccttctggatccccgcatgaatctcttccacatctccatccaccagcaacagcacaactatgctgccccttttcctccagaaagctgcttccaagaaggggctccaaagaggatgcccccaaaagaggctctagagagagaagctccagggggaaaggatgataaggaagatgaagagattgtgagcctcccacctgtagaaagtgaggctgcccagtcctgccagcccaaacccatccattatgatactgagaattggaccaagaagaagtaccacagctacctggagcgcaagagacggaatgatcaacgttcgcggttcttggccctgagggacgaggtacccgccctggccagctgctctagggtttccaaagtaatgatcctagtcaaggccacggaatacttacatgaactggcggaagccgaggagaggatggctacggagaaaaggcagctcgaatgccagcgacggcaattgcagaaaagaattgagtacctcagtagctactgaccaaaaagcctgaccattctgtcttaaaaagacacaagttttctttttgatctccctctcccctttagtaacttgtacatttttgttacagcaggacactctggacagtagattgcagaatgcattgcagccagtgcacaaacaatataaaggcttgcattcttggaaactttgaaacccagctctctctcttccctgacttatgggagtgctttgtgttttctggcacctttggcttctcagcaggcagctgactgaggagacttggggtcttcctggctcactatctccaaagaaaaggctgacagatggtatgcaacaggtggtggatgttgttgggggctccagcctggaggaaatctcacactctacatgaactttaggctaggaaaggatgtctctggggtgatgcaaggacagctgggtgtggacgctctccctgcggctccatttttttccaggagacacacaagctgccttgggtgaaaacaagctcagagacttgatcaacgtggaccattacctcactgtcagacactacagtagctgaggagttggaaaccttacatatatgtatatatgtatatatatatgtatgtatatatgtatatatgtatatatatatgtatgtatatatgtatatatgtatatatatatgtatgtatatatgtatatatgtatatatatatgtatgtatatatgtatatattatgatgttggctgacccccttcctcccactctcaatgctgtgactcagaacatttaagagaacttcgtctgtaagtaatttgtcttaaagccctctgggctctcttctctgagtgagggaactttctgtcttcacaagggactttgtctcattctgcctctgttatgcaatgggttctacagcaccctttcccgcaggttagaaatatttccctaagacacagggaaatgggtcttagcctggggcctggggaaagttcccaagccctggctcatgaactcaatccctgcccaggtgttttctgaggggcccttgaggcccaatcttttctcaagacaggtgtgaggcaccttagaagggagaactgtaacactttctctttcgcacctgcctctcatctcaatccttgactgatgaatttgaagttctactagaaccatgaaaacttgttcctttcgtgcatctccaaggagcttgctggctctgcagccacgcttgggccctcgcaccagcctgcaatgagtcagatgtctgtcacagaatctgggcctctctgaagttttctggagagctgttgggactcatccagtgctccacaacgtggacttgcctcctggtgtgttttaaaggatcctccaggagctctgcttagccaatcatcatgatggatttttttttttttttttgagacggagtctcactcttgtcgcccaggctggaggttaatggcatgatctcggctcactgcaacctctgcctcccgggttcaagcgattctcctgcctgagccttccgagtagctgggatcgcaggcgcctgccaccacgcctagctaatttctgtatttttagtagagatggggtttcaccacattggccaggctggtcttgacctcctgacctcaggtgatccacctgcctccatgatagattttgccccagctggactctgcagctccacgtggaatccaggtgctgcctccagtctgggaaagtcacccaaccccgcagttgtcatgtgggtaacttctgaaacccctaagcc

SEQ ID NO: 640 - DNA, 825 bp, Homo sapiens
cggcctccctatactggctgctatctctaagccacaggacagacaagagaaaaacaattagtcatcccaggttttgcccaccttccccaccgcccctgttattctaaacacaatcaccatagaaaacaagctgtggtgagaagccaagcaggcacctacaggtctgaaagacttgaagactttttccaggacttcgtggagcgtcttcttgccgcaggaggagatgtaatcctgtgctagctgcaagaaaggcaggcagtcctcgctctcactccacacgtgctgcgtgcccacgggcgacggaaggagaaaacaaagacacacagtcactacactcagtgtgaagttcagaaaagccaagcagattttcttaataacatcaatttgaagaaggcctccattctacagtaaaattcatacatgcgttcttgatttgtttgcgttgaaagggaagaaaaaatgtctaatctatagaagcccccgagcttttggtccatacctcacctgctctgttcatcatcagatctgctcctacacagtaaagagggcagtgggtggccattcctcaccaatgatttccactgttcaccttgtgcaggctaagggcggttttcagacatggggaaggagaaaccagagcctttgccttcaaaatccttaactttgctttcagctacggctgaaagattaattaagcatagtttgtaagcattaacttggaacaagacattctttacccagatcggcctgtgagtaggcgtggtggtaaatttacttccaaatgcaaataacttaagagaacccaccaagtcaccactatgtcac

SEQ ID NO: 641 - DNA, 2613 bp, Homo sapiens
gtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaatgaaaaaaaaa

SEQ ID NO: 642 - DNA, 1520 bp, Homo sapiens
tctgcccttgttaattaccggagcgacagactagggagctccgcccgggatttgcccatcggcggaggcgccaggctcccgtttctccccatccctctcgctgccgtccaggtgcaccgcctgcctctcagcaggatggacgtgatggatggctgccagttctcaccttctgagtacttctacgacggctcctgcataccgtcccccgagggtgaatttggggacgagtttgtgccgcgagtggctgccttcggagcgcacaaagcagagctgcagggctcagatgaggacgagcacgtgcgagcgcctaccggccaccaccaggctggtcactgcctcatgtgggcctgcaaagcctgcaagaggaagtccaccaccatggatcggcggaaggcagccactatgcgcgagcggaggcgcctgaagaaggtcaaccaggctttcgaaaccctcaagaggtgtaccacgaccaaccccaaccagaggctgcccaaggtggagatcctcaggaatgccatccgctacatcgagagcctgcaggagttgctgagagagcaggtggagaactactatagcctgccgggacagagctgctcggagcccaccagccccacctccaactgctctgatggcatgcccgaatgtaacagtcctgtctggtccagaaagagcagtacttttgacagcatctactgtcctgatgtatcaaatgtatatgccacagataaaaactccttatccagcttggattgcttatccaacatagtggaccggatcacctcctcagagcaacctgggttgcctctccaggatctggcttctctctctccagttgccagcaccgattcacagcctgcaactccaggggcttctagttccaggcttatctatcatgtgctatgaactaattttctggtctatatgacttcttccaggagggcctaatacacaggaagaagaaggcttcaaaaagtcccaaaccaagacaacatgtacataaagatttcttttcagttgtaaatttgtaaagattaccttgccactttataagaaagtgtatttaactaaaaagtcatcattgcaaataatactttcttcttctttattattctttgcttagatattaatacatagttccagtaatactatttctgatagggggccattgattgagggtagcttgttgcaatgcttaacttatatatacatatatatatattataaatattgctcatcaaaatgtctctggtgtttagagctttatttttttctttaaaacattaaaacagctgagaatcagttaaatggaattttaaatatatttaactatttcttttctctttaatcctttagttatattgtattaaataaaaatataatactgcctaatgtatatattttgatcttttcttgtaagaaatgtatcttttaaatgtaagcacaaaatagtactttgtggatcatttcaagatataagaaattttggaaattccaccataaataaaattttttactacaag

SEQ ID NO: 643 - DNA, 1294 bp, Homo sapiens
gtttttgagtccatcacccagttcagatcgagtcagaggccaaggaggagaacatgatgatggacctttttgaaactggctcctatttcttctacttggatggggaaaatgttactctgcagccattagaagtggcagaaggctctcctttgtatccagggagtgatggtaccttgtccccctgccaggaccaaatgcccccggaagcggggagcgacagcagcggagaggaacatgtcctggcgcccccgggcctgcagcctccacactgccccggccagtgtctgatctgggcttgcaagacctgcaagagaaaatctgcccccactgaccggcgaaaagccgccaccctgcgcgaaaggaggaggctaaagaaaatcaacgaggccttcgaggcactgaagcggcgaactgtggccaaccccaaccagaggctgcccaaggtggagattctgcggagcgccatcagctatattgagcggctgcaggacctgctgcaccggctggatcagcaggagaagatgcaggagctgggggtggaccccttcagctacagacccaaacaagaaaatcttgagggtgcggatttcctgcgcacctgcagctcccagtggccaagtgtttccgatcattccagggggctcgtgataacggctaaggaaggaggagcaagtattgattcgtcagcctcgagtagccttcgatgcctttcttccatcgtggacagtatttcctcggaggaacgcaaactcccctgcgtggaggaagtggtggagaagtaactgagcctgcgcttgagaccttctccacgcagcaggaagatcccaccgacccttcctggcctaatcctttagattaggtcacattacattaacatttaggaacccagaccgaaaagttgctgaaagggaaggagacacattcacaaagaaaagttgcgaaaattgcgaaatctgttgtgcacgctcaaatgaaaacgcctttcggctttgggcttttatttttttggaactgcgagtggcttaggtctagcctcattttgtttttgtttggttggttttatactatattaacttttattacggtgatccttttgtgccatgttcaaaagaagttcattcctgtctgaagtgggaaagttgcatttaatgttaggggtatttaatgtatttttgtaaatagtttagcactttctttttttacgtaaacctgaaatatattttaaatgtggaatgatgtatataaaatgtgcgaggatcctggtattgtaatattaaaaagaagtttctatatg

SEQ ID NO: 644 - DNA, 3178 bp, Homo sapiens
ggcttcaggagagaggcccgcggtgctgtgctgccgggcctcggcgcagagccccggcagagcgccagacgctgactgccggcaccagaatgctcgcgatgaggaagacaggcggagcgctgcgagctagcgagccctcagctctcgtatccatgacgcctgctgcttcgggggacccctggcatgctggggagtgggtctctgtggtacatcctgtaccgccctggccggcgccggacccccatggccccagaacctcccgcactgccacgggaagacagagccggacgtgacgccaccgtggaaggaagggaggggcggagcgtggctcggtgacgtcctcccaagatggcggagacagagtgaagaaactgtgttccccccttgggttgctatcgatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcgacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggagaaagaccatttatctgcgaattatgtggaaattcttacacagatattaaaaatttaaagaagcacaaaacaaaagtccattctggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctctcttactcctgttatgcactttttaaaataaatactgaattccagaaaaaaaaaaaaaaaaaaaaaaaaaaaaaaaaaaaaaaaaaaaaaaa

SEQ ID NO: 645 - DNA, 1823 bp, Homo sapiens
gagaagctaggggtgaggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggccccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataaaaaaaaaaaaaaaaaa

SEQ ID NO: 646 - DNA, 1744 bp, Homo sapiens
tacacccgacggcctcccgacccgtgcacaggagcccgcctgggccaggggcaggctggcagggtggggtgggggccatgcgggagaaagaaggggaatcacatctaatccactgtaaacgccttgatgtgcagcaacagcttagagggggctcaggtttctgtggcgttggctatatttatctctggttccatgccagcggggagggtttaaatggcacccagcagttggcgtgaggggctgctggagcttgggggctggtggcaggaacaagccttttccgaccccatggagctgtatgagacatccccctacttctaccaggaaccccgcttctatgatggggaaaactacctgcctgtccacctccagggcttcgaaccaccaggctacgagcggacggagctcaccctgagccccgaggccccagggccccttgaggacaaggggctggggacccccgagcactgtccaggccagtgcctgccgtgggcgtgtaaggtgtgtaagaggaagtcggtgtccgtggaccggcggcgggcggccacactgagggagaagcgcaggctcaagaaggtgaatgaggccttcgaggccctgaagagaagcaccctgctcaaccccaaccagcggctgcccaaggtggagatcctgcgcagtgccatccagtacatcgagcgcctccaggccctgctcagctccctcaaccaggaggagcgtgacctccgctaccggggcgggggcgggccccagccaggggtgcccagcgaatgcagctctcacagcgcctcctgcagtccagagtggggcagtgcactggagttcagcgccaacccaggggatcatctgctcacggctgaccctacagatgcccacaacctgcactccctcacctccatcgtggacagcatcacagtggaagatgtgtctgtggccttcccagatgaaaccatgcccaactgagattgtcttccaagccgggcatccttgcgagccccccaagctggccacagatgccactacttctgtagcaggggcctcctaagccaggctgccctgatgctaggaagccagctctggggtgccataggccagactatccccttcctcatccatgtaaggttaacccaccccccagcaagggactggacgccctcattcagctgcctccttagaggagagggcatcccctttccagggaggtaaagcaggggaccagagcgccccctcgtgtatgccccagctcagggggcaaactcaggagcttcctttttatcataacgcggcctctaattccaccccccaagtgaaacggtttgagagacgcagtgccctgacctggacaagctgtgcacgtctcctgttctggtctcttcccgatgccagtggctgggctgggcctgccctgaattgagagagaagaaggggagaggaacagccctctgttcccaagtccctggggggccaaacttttgcagtgaatattgggaaccttccagtggttttatgttttgttttgtttcgtgtgttgtttgtaaagctgccatccgaccaaggtctcctgtgctgaagttgccggggacaggcagggaaaaggggttggggcctcttgggggtgatttcttttgttaacaaagcattgtgtggttttgccattgttttgtattttttttttttttttttttttttgctaacttatttggatttccttttttaaaaaatgaataaagactggttgccagaa

SEQ ID NO: 647 - DNA, 5550 bp, Homo sapiens
ctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagggaagttttggagtttgcaaccacagtattcctttgtctgtcgaggctgggagggtagccgtgagcgtggtgggtgggtggtgtgagtggcatcttggcctggaggacacgcctggggcagcgtgtctgtgctcagtgagggccgatgaagaaagtgcgttttctgttttcatttaattcagttttgtgttaagggtggaacaaagctctgttctagagggaaagttaggaataggcctcccagaggatactccagacagttgacaagcatcgcagcccctgtcaggtcaaggaattttaacctgggagactcctgaaaatcagcctaatgtctgggggcagctggcgctgaggctgtgcagatgtgtatggccttgggtcacagctccctactggggctgcagcctttagaccctgggtctgggatccacgtctagggaccactctggcttctgtgcatccacccaggcccccgacccatcactgccacattctccgggtcatggccgagcttgacctctgcatccatggtgacggaggtggcaatgacatcatcaaggtcagagggtaaattcctaacaggagaccacaaaggtttcacttcttttagatccatccaatatgcgaaaaaagggtacattttaatttaatgtgttaaaaacacaatgtccctaccgtgtaaatagaatccaagtcaattgtgactgcaattccaagttagtatttaaaaatagagaaattgcacttcctggaaaaaattaaaaagtagttagtttaattattctgtaaattatttaattttgtcaagatgtaagtatttatattcacagcctcttatgttaacgtttgctatttatttaacatttttatttattaattttatactatttcaactagaccccacaccagggcaccctaagaggggaaaaaagtgaattcaaagcaaaaataactatttgactataatataggccacaaaaaatcttgatataactcctagttataattttgatgcaaccaagttattttttatatattttgttatttattcttttaataatggaatttttttaaaaagtattttgtaactgaggaattttgataatttggggattttgttttcccttggtctaatggagagaaagacattttggttttctttttccattttgggttccttttgtttcaggcacggataacagcaaatggaattctgtatttattattatttaagtgtagcgcagatgtgtgtgcttgggcgtgtttctcgtgtcgcgtttgcgtgtcggctcttgcggtggagtcctgttgctgtgagggagtgctggccgcaggcagcctcgagtcaccgccaggctcacaggctgtgccacccgtccctccgacagctccaatactgtgaccctccttcctcaggaagcgcgttgaacccacagcactccgtggtgtgtttgcagggtgatttcctaataaaagtccactctgactgtgaaaaaaaaaaaaaaaaa

SEQ ID NO: 648 - DNA, 4662 bp, Homo sapiens
ctgttgccgcgccgggtgggtgcattttaattttttcattccctgaactatgggttatgatatccatactcactgaagacaaaaagccaccttttctgcgtcttggtggcatgcatgtgtctcatcatcctttcaaacttgtggtggaacagggttttcttccctgtctgtgtattttgagccagcacagttaccaaaattgaacttgtctttcgcttgtgaacggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcattttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaagtgtatatggttgtcccttggcgaaaaaaagaaaaacacaagataaacagccccaggaacctgctcctaaacgaaagccatttgccgtgaaagcagacagctcctcagtggatgagtgtgacgacagtgatgggactgaggacatggatgagaaggaggaggatgagggggaggagtactccgaggacaatgacgagccaggggatgaggacgaggaggacgaggagggggaccgggaggaggaggaggagatcgaggaggaggatgaggacgatgacgaggatggagaagatgtggaggatgaagaagaggaagaggaggaggaggaggaggaggaagaggaagaagaaaacgaagaccatcaaatgaattgtcacaatactcgaataatgcaagacacagaaaaggatgataacaatagtgacgaatatgacaattacgatgaactggtggccaagtcattgttaaacctcggcaaaatcgctgaggatgcagcctaccgggccaggactgagtcagaaatgaacagcaatacctccaatagtctggaagacgatagtgacaaaaacgaaaacctgggtcggaaaagtgagttgagtttagacttagacagtgatgttgttagagaaacagtggactcccttaaactattagcccaaggacacggtgttgtgctctcagaaaacatgaatgacagaaattatgcagacagcatgtcgcagcaagacagtagaaatatgaattacgtcatgttggggaagcccatgaacaacggactcatggaaaagatggtggaggagagcgatgaggaggtgtgtctgagcagtctggagtgtttgaggaatcagtgcttcgacctggccaggaagctcagtgagaccaacccgcaggagaggaatccgcagcagaacatgaacatccgtcagcatgtccggccagaagaggacttcccaggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatggtaaagatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaaggtgcaaaccagggatatatcccccaaaggatatgatgatgcgaagcggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaagtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagtgccccacgcctggctgtgatggttctggacatatcaccggcaattatgcttctcatcggagcctttcaggttgcccaagagcaaagaaaagaggtatcaggatagcacagagcaaagaagataaagaagatcaagaacccatcaggtgtccggtccccgggtgcgacggccagggccacatcactgggaagtacgcgtcccatcgcagcgcctccgggtgccccttggcggccaagaggcagaaagaggggtacctgaatggctcccagttctcctggaagtcggtcaagacggaaggcatgtcctgccccacgccaggttgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcagattaccacgatggagagcaacctgaagaccatcgaagaggagaacaaagtagttgagcagcagaacgagtctctcctccacgagctggcgaacctgagccagtctctgatccacagcctggctaacatccagctgccgcacatggatccaatcaatgaacaaaattttgatgcttacgtgactactttgacggaaatgtatacaaatcaagatcgttatcagagtccagaaaataaagccctactggaaaatataaagcaggctgtgagaggaattcaattcaggtctgaacagctgctgtagtgatgaaactcttgcttaaaaaggatgcctcttgttttttgctgctgtaacttaccagaaagtgttctatatttatttctgtttgaatttgaaacagtgttatgcttacaagacttcataatgattttatgtcttgctttaaagatagtacctgcagaatagtttttgaatacacccacattttgtacgtttccatgtaagctgacatagtgttctgccatgtaatgtttatagctgctgatgtatgcacatttgggggtatatctatttctgaagaggtaagctgatcaaaataaatagagtgtaaattctttttaatgc

SEQ ID NO: 649 - DNA, 2295 bp, Homo sapiens
tattttagttagcgaaaggacataatcatcaatgtttataatctggagtgcgttatcatggtttatagcaattagttcatttgcatttatgtttttatattcatcagcaaaattgcaatgggtatttggattgattggaattagtcagatacttttatggctactaatatggcgtttttcacgttcagacaagaacggtagcgattaaaatatttcggcagacatgtgcgtacatttatagcgtccgctttgttagcatgtattagacgttaacgaacgattcgcttacatcaaatttgaacgatacggttgctacatggtataattttgttagaagaattgtggtttggagtcttatcttcaatccagagcttgtcgtctgtcaacgatgagctttttttgtgcaaaaaaatagccccgtcctgtcaaacgaggcacttgtattagcgacgattgtcgaaatacttttgcaacaagattaatactaagccagcaaaaatctgccaaagtgtggcttggagctgttgcattagaaggattgcggtttgcatggagtctcacctcccttctgggcgtctaatctcaacgccacgagaaatagtataccatgactttaaaatggcttagaacgcaaataagagccgtttaagagtatttaagtttgcggtggtatcttcgtatcggtggcgcgaccaaagggaagcagacgacacacagcaggacactccaagtgtccagtgtgctggggtgccgttaagaaatgacgaccagtcattttaggcatctcgtccttgccgatatggagataccacctctaggcgaaatgaggagagctctgctcgacgattggagactttttgacgggaggcgatcagcgccagaaaaaaccggctgttactaacagccgaacagcccgctagaggtttcctttaggtaaccgcacaaccaaaaaagcagtcagaatgacaagccaaataactagtaattcgcccgtaaaatggaaacgtagaactcgtcatgacacttgtggtaaaataacattattcgccttgcaaaaaacgatgtactttgacaatttaagcacaaaaaaacacaacctcgacaatttagagttagagaggtcgtgttttgagattagtgagactatggatagttcattaagtattataacatactcaatgagtgtacatagtctccagaaaaatggagaacccatgaaacaagaaaaacagcagtttataaaaacggattggacgattgacatgataaatcgtcggcaatttgagaaatatgccattgatattctcacagctactaaggatattcatcgcggtggatgggtagaacgaattgataataaggcttggcagtatgtcagagtttatgaaaatggcgacattgaagttttaattacacttcagataataagattccacaaatattttgatacaccagtttggttacagtttaacccgaatcatcttttacccgcagattatgtgcaacttgatcatgtgatgaaatatgttgatcactcacatttaactcgcgccgatttagcaaatgatatttataacatcaacttgcaacgttacgattttggattgtttggagtaactagagatatctatcgtagtttatctggtgatttagaaacacggtattggggacgccgaaaaagtgagcgccaaattcgtctttatgacaaaatgcgcgagatgaaaaaacatggcaaagcagatgatattccagacggtattactgattggtggcgtttagaatttcaatttagaggtggcaaggttgagtcatggcaagaagaagtaatggacaaaatgcagtcgttccatgttcttgctgttgatgataatgatgatttaagtgaaatagataaagccattttagcacgtgttaatgccgataaatttgattttaaaagagtcggtaaacgttatgctgcaaaaattcggaaaatggtacgtgaaaacgttggttttgatacgaccgttgcagaattatctctcaaaacattcaacgaacaaaaagatgagttgcagagacaactagatagcatgcttgcaaaatataatatcggtgcacaaacagaagaaatgacagcatattttgaggaagagcttaaacaaacaggtaatcttgatttttctgttgttgagagtgaatctgcgttagagcgtaatgtgatacgaaatattgctaaaacttggcgtgaagaaaatagtttaacgcacagaactaatactaatagttgatgcgtattttttatttttctaatat

SEQ ID NO: 650 - DNA, 4499 bp, Homo sapiens
gccgccgccgcggccaagcgagcgccgtcggggcgggtgggcgggaagaagcggcgggcccgaggtgggggggagcagagagagcgcgcccaccaccttcccttcccccctcgatgggagcgggggcgtcccggctcctgcagccgccagaggagggagagccgggggccgtcgcttcggagttggggctgagcagtcctcggggagagcgcgccaagaccgctgcagccgctggctgacggaaggagagttttacatggaagtggcttacagaaacttggcgctgaggtgcagggaagccagaaactctttgtgtctctaaggccgatgaggaatttggaaacacatgtgggacatacaagcgttggatatagaggactgagcagggggaggaacatttaagctgatggaagtggaagtggaagttgctgtacattggcagcaaggcctccgagttagcttttgaatgcagttaactggtttctcttaactgtggaattcattgaaaagtcagactccgagtggtcgttccaggatatcttgaaaagcccaggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcgagaagtcacctataaatatacttacagaaccaccaagtcaaaatgtggagaaagagatgaattatccccaaagagaattaaagtggaggatgggtttccagatttccaggattctgtgcaaacactcttccagcaggctagagctaagagtgaagaacttgcagctcttagttcacagcagcctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatggcgactgttaacaaaggctgtaacagattaagtactattttatatccagaaagtcttctctatgtagagaagtcagagagactagatgctttcactagggaatgtcttcccacccagccatcacaaatgtggacaatcactgcatccacatctgtaggcatatttctatggaagtttaattgacagctatattcattatttattttacaatttcatttttctacacctttgagatttatgaatgcagttttttcttaaaatttattttaacttgacagtatgtttttagttcccccaatttaattaatggaccatgtgcatatatatgggagtgtgcttacatgttaataatttacttgcatacttatgagaatttcacattggaattcataatggtaaaacaacatacatctgccaatatacgttttttctgttggtttaagagaagataactgacagctttacctacttcctacagatgcatctaaacccagatattactgagaagagtgtattgactctgagtgtaagagagtatgtgtttttttgtttttagttctgctctagatcataattgtaaaaaatattaagtcataatctgttacactaaaatttgtcagccaaatgttagatgaaatgtctgcactgtagtctcagatcactgtcacgtatataaattgcttcttcattttaatttgtagaagtactttacagtaggaaacgccagtaaacaacttttatactgttaaaaggcttttttccccttcctaaatgttttaattgtaccatagtgttttgctcactgaagaagcttcttatggaccttgcaactttgttgctagcttgaggttgattattgtggttgtattgttcactgtgtgtagaaatagtatgagtacgatttcaatagactgttcagtttttaatattagccatagcactggttagtatatctcagtagtttcatgaaacgtttcctgtattctaatctattttgaaacattttgtttttttttaattgtgtcttacagtcaagtttgtagattttcataagccacaattttaaaagatgcagtaatcttccaacttccaatatttatccattcgttgtggacccacagattgcatctttaaattcataataagtttccttaactatcttatgtttctagtctttcaagcttagtgataaggtggaagcacaagaaaaatttcagtagaatacagtttttattttgtaaacactaatgtattaaacttgctatacattaaagcaaataatatatatttttatttgaattgtatatgtgaattggaagttataattagttgattttttcattttgttagaggtattttcactgaacaaggtcaattggttacctcagtattacagccaatatagtccaagggaccatttctccccgagtctcttacactttattgtgcgatgtccacgtttttgtgactcttcaagctgttggtgaggtgggacgaatgcacttgcttcctgtggcaataaagattttctgtgcctcacaaaaaaaaaaaaaaaaaaaaaaaaaaaaaaa

SEQ ID NO: 651 - DNA, 2725 bp, Homo sapiens
ctctcccagtctctaagccgcggcgtctccgcggccgagaggccccagcgcccgcctccccggcccccgcccccacccccgcccccggctctgcccacgccctccgcccgccagcccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgagctcaccatcaacgaggctgctgcccagttctgcatgagggacaacacgctcttattacggagagtggagctcttctctttgtcccgccaagtagcccgagagagcacctacttgtcctccttgaagggctccaggcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttaggaaaaaaaaaaaaaaa

SEQ ID NO: 652 - DNA, 3735 bp, Homo sapiens
agtcacaacttcgggggttgaggttgtcaaggagctgtccgtgatggttctatggtgtgtgcgtacacacatactctctctctcacacacacacaccacagtgacagatgacctattgaaataatttcagagccggtctgtggttgctacgacaaccaatgatctcttggctttcatctggccatgtgacagggactttgacgtcagctagaggcagagtctgtggctgagtccacacagtcaaaggcttgtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtggcccgtaaatcagttgactgtgtagctcttgcctggcattaaagcatgtttttggtttaacatgaaaaaaaaaaaaaaaaaa

SEQ ID NO: 653 - DNA, 6895 bp, Homo sapiens
ttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 654 - DNA, 778 bp, Homo sapiens
agggggtggtggcgaggctccgcaactttggaaactgccatttcattcacacaaggcactgcctgggggagggggctgttcctggctgcagaattctagctctcacgagcacgcagacaaccgcactcgcagcggtgtggggccggctgctcaggggaagccccaggctctccgacccagctaccgggaatggggcaccctttggagaagaaccccagcctggggtggggacgcaccggctctccgacagctcaaacacagacagatcttctagagccgagggaatttcttttcgcagaagccattactccccccgagagaaggctgcaaagctgggaagcccagggtgtgctcctcccgcccttttggacccccgggcttgcaccggctgcactctgagaaccagctgcgcgcggagcggtgcaatgcagcacccaccctgcgagcctggcaattgcttgtcattaaaagaaaaaaaaattacggagggctccgggggtgtgtgttggggaggggagaccgatgcttctaacccagcccccgctttgactgcgtgttgtgcagctgagcgcgaggccaacgttgagcaaggccttgcagggaggttgctcctgtgtaattacgaaagaaggctagtccgaaggtgcaaaatagcagggagaggacgcgcccccttaggaacaagacctctggatgtttccagtttcaaattgaaagaagaggggcgccccccttgtttgaaaataaataaataaataagtgcgagctacaaaaaaaa

SEQ ID NO: 655 - DNA, 2227 bp, Homo sapiens
gtgctcccgccccccgggaatgaatggatgggcggcctcagcgcccgcccgaccgctgggaggaccgacccggcggggacctgctgggggcaggacccggggagcaagatggccactgtcatccctggccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgataagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacggtgccagctgggcgggtctcaccccccaggaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccaaaa

SEQ ID NO: 656 - DNA, 2641 bp, Homo sapiens
gagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaagccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgaaaaaaaaaaaa

SEQ ID NO: 657 - DNA, 3048 bp, Homo sapiens
gtagagatgccacactcgctccgcggttcgcatggcgctctgaagacgccggcgcccgccgccttgaggagccgctgcccccgctccctgaagatgggggaacaatgaaataagcgagaagatccctcttctcccccctctctctcttgccccctccccccctcccctcccctctccccttgactcctctccgaggcaccatgctgacccgcctgttcagcgagcccggccttctctcggacgtgcccaagttcgccagctggggcgacggcgaagacgacgagccgaggagcgacaagggcgacgcgccgccaccgccaccgcctgcgcccgggccaggggctccggggccagcccgggcggccaagccagtccctctccgtggagaagaggggacggaggccacgttggccgaggtcaaggaggaaggcgagctggggggagaggaggaggaggaagaggaggaggaagaaggactggacgaggcggagggcgagcggcccaagaagcgcgggcccaagaagcgcaagatgaccaaggcgcgcttggagcgctccaagcttcggcggcagaaggcgaacgcgcgggagcgcaaccgcatgcacgacctgaacgcagccctggacaacctgcgcaaggtggtgccctgctactccaagacgcagaagctgtccaagatcgagacgctgcgcctagccaagaactatatctgggcgctctcggagatcctgcgctccggcaagcggccagacctagtgtcctacgtgcagactctgtgcaagggtctgtcgcagcccaccaccaatctggtggccggctgtctgcagctcaactctcgcaacttcctcacggagcaaggcgccgacggtgccggccgcttccacggctcgggcggcccgttcgccatgcacccctacccgtacccgtgctcgcgcctggcgggcgcacagtgccaggcggccggcggcctgggcggcggcgcggcgcacgccctgcggacccacggctactgcgccgcctacgagacgctgtatgcggcggcaggcggtggcggcgcgagcccggactacaacagctccgagtacgagggcccgctcagccccccgctctgtctcaatggcaacttctcactcaagcaggactcctcgcccgaccacgagaaaagctaccactactctatgcactactcggcgctgcccggttcgcggcccacgggccacgggctagtcttcggctcgtcggctgtgcgcgggggcgtccactcggagaatctcttgtcttacgatatgcaccttcaccacgaccggggccccatgtacgaggagctcaatgcgttttttcataactgagacttcgcgccggctcccttctttttcttttgcctttgcccgcccccctgtccccagcccccagagcgcagggacacccccatcctaccccggcgccgggcgcggggagcgggccaccggtcctgccgctctcctggggcagcgcagtcctgttacctgtgggtggcctgtcccaggggcctcgcttcccccaggggactcgccttctctctccccaaggggttccctcctcctctctcccaaggagtgcttctccagggacctctctccgggggctccctggaggcacccctcccccattcccaatatcttcgctgaggtttcctcctccccctcctccctgcaggcccaaggcgttggtaagggggcagctgagcaatggaacgcgtttccccctctcattattattttaaaaacagacacccagctgccgaggcaaaaaggagccaggcgctccctctttcttgaagagggtagaagttagggcgccggagcccgggcctggaacgccctcacccccaacctccagtctccgcgttttgcgattttaattttggcgggaggggaagtggattgagaggaaagagagaggccaagacaatttgtaactagaatccgtttttcccttttcctttttttaaacaaacaaacatacaaaaaaaaaaaaaaaaaaaaaaaaaaaaaaaaaaaaaaaagctaagaggcgacggaagccgaacgcagagtccggatcggagagaaaacgcagtaaggacttttagaagcaataaaaggcaaaaaaaacaaaaaacaaaaaaacaaacaaaaaaaaaccactactaccaataatcaaagacacaaatatctatgcaaggaggctccactgagcctcgcggcccggcccggccccgggatgccccgcccggcctgcgggccgccccgcccgagcgcggatctgtgcactttggtgaagtgggggcccgcgccgccccctccccctccccaggttcttacaatcagtgactcggagatttggggccccagtgccactgccctcccccgccccgtccccgttgtgcgtcatgctgttttttaaaaacctgtttccaaatttgtatggaatggcaaactgttggggggtcggtttggggagggagggtttgcatgaaagacacacgcacaccacaccgcacgcacaagcaggcccggcgccggcgtccggggggcagaaggaggtgagctcgccggctcctcctccccgcggccattctgtcccctcctggggtgaggggtggggatggagacctgggggcagccccacccctgcccggactgtgcctcggtgggtgccacctggcgatttccggtgtctggagagagtattttttggtccaaggagtcctcttggctttagctggtgggtgggcggggagaggtctgagggctcctactggaggttcccccaaaaaggggcaaaaggagaccctctgcccaccggaggcaggggatcaggcatccaaatacacgatgcaaaaatgcaatcccacaggcgacacacccacacactcacccacacacacgcaattttaccttcctcttgtagcgaagatgaaactcccgtcggacacccgaagtgcattgcgtgtttctgttcagtttaatgacgattaataaatatttatgtaaatgagatgcaaagccggaaaaaaaaaaaaaaaaa

SEQ ID NO: 658 - DNA, 3971 bp, Homo sapiens
aaaactgcagcaagtcagaggctccggccagagagcaggagctgcccagaggcttgtggtcctgaaagctcctctccggggagctaaccagggagaggaggtactgaagagcgactaaactggctgcagcggagagatcagcccgaaggcgtccttgaggagcatacggaactccaaggaaggagtagaataaggagcaggcagagaaaccagacccggtggaatctctaagaggtaacaaccgggtttgacatggatcgctgaaagcgtctcttctaccatctggatggtcagggagacttggcttctctgactgtcctctaagacgcagattcacagagttcactccaggaacggccagtgaccgagagtctggaaatgtcaaaaacttttgtaaaatccaaggagatgggagagctagtcaacacaccatcctggatggataaaggtctgggctcccaaaatgaggtgaaggaggaagagagcagaccaggtacttatgggatgctcagcagcttaactgaagagcatgacagtattgaggaagaagaagaagaggaagaagatggggagaaacctaagagaaggggtcccaagaaaaagaagatgaccaaagctcgccttgagagattcagggctcgaagagtcaaggctaatgccagagaacggacccggatgcatggcctgaatgacgccctggataacctgaggcgagtcatgccatgctactctaaaacccaaaaactttccaagatagagactcttagactggccaggaactatatttgggctttatctgaagtcctggagactggccagacacctgaagggaaaggctttgtggagatgctgtgtaaagggctctctcagcccacaagcaacctggtggctggatgtctccaactgggccctcagtctgtcctcctggagaagcacgaggataaatctcctatttgtgactctgccatctctgtccacaacttcaactatcagtctccggggcttcctagccctccttatggtcatatggaaacacatctccttcatctcaagccccaagtattcaagagtttgggagaatcgtcctttgggagccatctgcctgactgcagtacacccccttatgagggcccactcactccacccctgagcatcagtgggaacttctccttgaagcaagatgggtctcctgacctagaaaaatcctacagcttcatgccacattacccttcttcaagtctaagctcagggcatgtgcattcaactccttttcaggctggtaccccccgttatgatgttcctatagacatgtcctatgattcctacccccatcatggtattgggacccaactcaatacagtcttcactgagtgaggcagttaagttcaatgtttcagagaatgacgtggagacattttccataattcaagtggttgagctaaagattcaatgaccttaaaggatccctatggatatatatcaaacaatagttcaagtccatttaggctttccttcacctatcacctcttttctcatcaccttctcacattgcattgatttctttatagagtcctcaagtgaaaatatttgatgatttaacaaccatgtgaaaatagaacagaagacctgggccctattccagtggtgccaaaaactcattgcataatctgtgccaattaattttccatttctggcctttgtttatttactagcaattgtaaataaacaaattgtatttatatgaggcaactattctaagtccagatgatttctaaagtccttcacagttctgaaatgctataactgtggtgatcactcttgacaatttcttgaaactgaaagaatagagaaataataggaaagggatgctatgcatagaatgatcaaattgaattatcagagggatcacaaggtacatgtctcttggctcacagaatgcaaagcttgtttggatttaatgataggacctctttgtatctattgaaaaatagcttctggaagctaaaagtctaacatggctgtcactgtgaagaacaaaacatgttcgttaagagactaactctatttgttattagactaaaagttgaacatatcttccttatgatttgaagaaccataatagagaaccataatagaggcctcatgccaactttattcttgataatatttcaaaaccatttttctcagtactagaggtagggcaaacaagtcactgaagcctcagactcctataactaatgggacatagagaagtcttttagaccatgacctccataaccagagggctctggaacttctgatgaagctcaggtgctgctgttagaatcagcacacaacacaggtttatattaaagagcaataaaatagctattggctataataactactatagttcagggactctctccagctcacagttgcccatgggaaaaaccaatggatttttttttaagcaagatgaatttcatttggttaaacgtgattaaaaccatccacctctgtccacaccaatatattttccagaagcacaagcaccaatcaatttattgatcaaggttaaatttttccaacatatatgtagttccttatctctccccctacactaattgttacctcttcctcacttctaagatagaatatgttattatatattgtaaataacatttcaggtgaccaaacttaaggatgcagaaatgaaatccaaggttggtgaatatttttaccaactatgtcttcatcacaggtttaacccaatttgcagagtgtttatttttctttatgtaactcctttttcctttatatcaatgctaacttcatcaaatttgtattttttttcagaaaatgggacctgagaaattttcctatcttgttcaatcagccaggacagttatttaagtcaaaccagagcctgaatggcttatttgatagtagattaggtcctgctcctgccagaaaggataagtttaacatgcagggtacatcaatagggccaatttaaaaaatgataacacatattagtatgtcattttctatagctcagctatcccctaaaatctgccaactatatgtgtatcttgtctgtttacctctcttatttattatctccatacagtataagttattttttttccattttgctctcagcacttaccctgctgtattttgcacccttggtttgtaaattcacttgaaagtagccttgcagagagatcttaagccccatcagtcaccaaagtggttcccttcatcacaatctgccctagaggaaataggcaagtaaaatgatatataaagccatactatgtgctttctgagtatatactgcacttacctttgtgagcggctgtaggagggtctatcctcgaagctagcattttctggcatttaagtttgtagataatcactgttgtttgagttatttattagatattatttatttaatttatttctctcttcctttcacgaaaattcctttagccccatagatgtgcttgcaaacccttcctaaaattttatttggaaagtagctcataattttgctaagaactgctgagttttggagtgaggggaaaggaaaaaatagagaattacctctgtgataatttttataaaaagcagcaataattcgaatggctatgcaagttaatgtttttagagtcttttcttcagtctaaaatgagccagagttattctttaataatctgctgtttatgcctttggggagtatggtacccatgagccaagcctccctgaaattgtacagagggattttataattgaattaaaatttaggaatgcaatagcttgtaaagagcctgctctccaacatagggtggtctcattcttctggagacttttttagataaagtaaaataattgtttaaatattttgtttaaaatatgactgtttttcctccctttttcctagcagaaataaagctgtaagtcttattagaaaaaaaaaaaaaaaa

SEQ ID NO: 659 - DNA, 2175 bp, Homo sapiens
tgaaatgctggtgcagatttttttcctatcagtctaaccttctgtgttgatgcatgaaggctggtacccacttacagggatgccagatgatcagtgcagaatgaaggtcccaagagagaggatcacatggctctctctgccctgtgacgtcactagcagatggcatgggtaccagctctggcagttggcatcaatgtcactttttagagatcaatgagatagtgcagatatacacagatctagagactccaggagacgatgcgacactcagcctgaaaagatttggaagacccaaaatgaaaactgattattgaatgaaattaaaacctaaggtaatttaagattagagaaccatgttaacactaccgtttgatgagtctgttgtaatgccagaatcccagatgtgcagaaagttttctagagaatgcgaggaccagaagcaaattaagaagccagaaagcttttccaaacagattgtccttcgaggaaagagcatcaaaagggcccctggagaagaaaccgagaaagaagaagaggaggaagacagggaagaggaagatgaaaatgggttgcctagaaggaggggtcttaggaaaaaaaagacaacaaagctgcgattggaaagggtcaagttcaggagacaggaagcgaacgcgcgcgagaggaacaggatgcacggcctcaacgacgctctggacaacttaagaaaagtggtcccctgttattctaaaacccagaaactgtccaaaatagagactttacgactggccaaaaactacatctgggcactttctgaaattctgagaatcggcaagagaccagatctgctcacattcgtccaaaacttatgcaaaggtctttcccagccaactacaaacttggtggcaggctgcttgcagctcaacgccaggagtttcctgatgggtcagggtggggaggctgcacaccacacaaggtcaccctactctaccttctacccaccctaccacagccctgagctcaccactcccccagggcatgggactcttgataattccaagtccatgaaaccctacaattattgcagtgcgtatgaatccttctatgaaagtacttcccctgagtgtgccagccctcagtttgaaggtcccttaagtcctcccccaattaactataatgggatattttccctgaagcaagaagaaaccttggactatggtaaaaattacaattacggcatgcattactgtgcagtgccacccaggggtccccttgggcagggtgccatgttcaggttgcccaccgacagccacttcccttacgacttacatctgcgcagccaatctctcacaatgcaagatgaattaaatgcagtttttcataattaatgaggaaaatgaaaataaacagtggtcattcacctcccctgtctaattaagacaaagcagatgcttgtgggctgagtaattggcacaactctatctaaggtgtttactagtttctgaagtgtgtttcaactattgtgagaattttctatgtaataataaatctcttttcgtatgagaacttcttttcctttccttttgtctgtgaagcactgtgattctgtttctactggaaagatttttttctttttaattttcttttaaacttatttaatttgtttgaacaaggtgtctaagaatatactgttgaataaagacatgcacacagcataattcaatgtctattttggttgtacagtaattataaaatgcatgttattaaaaccagatgagtaaaatgatgtgtttataattattaggaattatatattatgtatcttttaaaaattgaaattttaaaatatggagaatatcactaagctgacaatgatattgggagatgaatttgcaacaatataaaaagctatgcaattttctttttattaaggatgaatctaaatgcattcaattggtaactattcctcttcaagtatttgcagatggggcaacatgatatttgggtagctgatgtcataattcggggacaattatctcaatcatcaagaaaaaaatttcagcacttgttttgtattattcagaaattaactgtacaggtttgttatcacaatgtataattgtgtttttccaccccacatttttaaggcaattaaatatagatatttccactcgtaaaaaaaaaaaaaaaaaaaaa

SEQ ID NO: 660 - DNA, 1717 bp, Homo sapiens
cacacgagctgatctgatcgccggcgacatcactcaggagaccggccgggcgcgtggcccctgcaggcgaggcgaggaggccaggccaagttctccgtgcgcccctgcacccttccaggctctcgcacccgcaactggcacagagtaacaaccccaggctgttgggaacgtaagtgcgccctggcggctctgccctcagtccgggctgcagcgctctgagcgcctttctatctgtccgtcggtcctgcacagcgcaacgatgccagcccgccttgagacctgcatctccgacctcgactgcgccagcagcagcggcagtgacctatccggcttcctcaccgacgaggaagactgtgccagactccaacaggcagcctccgcttcggggccgcccgcgccggcccgcaggggcgcgcccaatatctcccgggcgtctgaggttccaggggcacaggacgacgagcaggagaggcggcggcgccgcggccggacgcgggtccgctccgaggcgctgctgcactcgctgcgcaggagccggcgcgtcaaggccaacgatcgcgagcgcaaccgcatgcacaacttgaacgcggccctggacgcactgcgcagcgtgctgccctcgttccccgacgacaccaagctcaccaaaatcgagacgctgcgcttcgcctacaactacatctgggctctggccgagacactgcgcctggcggatcaagggctgcccggaggcggtgcccgggagcgcctcctgccgccgcagtgcgtcccctgcctgcccggtcccccaagccccgccagcgacgcggagtcctggggctcaggtgccgccgccgcctccccgctctctgaccccagtagcccagccgcctccgaagacttcacctaccgccccggcgaccctgttttctccttcccaagcctgcccaaagacttgctccacacaacgccctgtttcattccttaccactaggccctttgtagacactgttactttccccctcccctagtcagcaggcaatagatggggccccagctgccgcctcgggaccccctctccaggcggagggaggaagcgggagctttaaagcagtcggggatacctgagccgcttgttaggtcgccgcaccctcgcggcggatgtctcttggtctgtttctccggccctcagcccagcgcccctcctgcccgcccctagacggcctttccttttgcactttctgaactccacaaaacctcctttgtgactggctcagaactgaccccagccaccacttcagtgtgatttagaaaagggacagatcagcccctgaagacgaggtgaaaagtcaattttacaatttgtagaactctaatgaagaaaaacgagcatgaaaattcggtttgagccggctgacaatacaatgaaaaggcttaaaaagcagagacaaggagtgggcttcatgcattatggatcccgacccccaccactgcagactcgctctaggaagaactggagactcttgcttagctattcaggcacagggctggagagtactttaatttattcaagatgcttcattcatatgaaaatgtatttttgtacataaagagtttattctattatgagctatcaaagtttacatttttgtactgcagacgcttcatgtaaataaaaactaaaaataaaaaaaaaaaaaaaaaaaaaaaaaaaaaaaaaaaaaaaaaaaaaaaaaaa

SEQ ID NO: 661 - DNA, 6123 bp, Homo sapiens
ggcctcccccgccttggcggccctgaccccgctgtcatccagcgccgacgaagaagaggaggaggagccgggcgcgtcaggcggggcgcgtcggcagcgcggggctgaggccgggcagggggcgcggggcggcgtggctgcgggtgcggagggctgccggcccgcacggctgctgggtctggtacacgattgcaaacggcgcccttcccgggcgcgggccgtctcccgaggcgccaagacggccgagacggtgcagcgcatcaagaagacccgtagactgaaggccaacaaccgcgagcgaaaccgcatgcacaacctcaacgcggcactggacgcgctgcgcgaggtgctccccacgttccccgaggacgccaagctcaccaagatcgagaccctgcgcttcgcccacaactacatctgggcactcaccgagaccctgcgcctggcggatcactgcgggggcggcggcgggggcctgccgggggcgctcttctccgaggcagtgttgctgagcccgggaggagccagcgccgccctgagcagcagcggagacagcccctcgcccgcctccacgtggagttgcaccaacagccccgcgccgtcctcctccgtgtcctccaattccacctccccctacagctgcactttatcgcccgccagcccggccgggtcagacatggactattggcagcccccacctcccgacaagcaccgctatgcacctcacctccccatagccagggattgtatctagagctgccatttctgctacccacgccaggccttagtgggttccctttcctgtccccagtcgagccctcctcccttcccctgcccctcctttccacgccctggaaaccatctcacttcacagggcaggtgtagcctttctgattcctcggttgtttcttgcatttcttggctttgggtatccttcattcagacgggctctgatttactgaaggtgtgatggagcttattgtcaaagccaagggtggcgttttgggggcgcttcttgagacgaaaaagaccctgggaagagatgatggtggcatatctaaagagtttgcagagcggactgacgctcctcccctttctctttaacgccgaaggacttggtgcagttcgtgtgaatctcacagggggaatgcaactggttcctgtgatctcttcacctttgcttctacatagagatgttaatgtcgagtagaaagaaatgtatcttagcatctgaatgattttgctggtaataatattatccacagatttgcaatggctggcatctgctttattcccattgctgtctgcaggctgtgggaatttcacctgtcaaaccaaacttccctctctgatgtgcactttgttctgtttcccagattcgtcacaatgcctattgtcctgtccttctctttcctttttcttccccattttgccatctgtctcttatgatttataaggggaaaaaaacttgttttgttagaggggcaggttagaagtcattgtataatttgtaggctttgtaatgattgaatgcaagcgtggaaatttaggctgaactctctatcaaaaggaaaaatgtggaggaaaagggaaaaatcaggagggaggattgcctcatgtattatttatttcgaccttttaggggagaaggaactcccccattctttcaagagattaaaaataaatcaacagtctgaaaacctaagcagacacggagcattatccggatcagccacacacgtgttcccttctatttattataaagaaatttttcatgggaaaatatgtattttttgtatattctacagagtttattctagtatgtatttacatcttgaagaacaagaaagttgttcttgtgattaaactataaataaactatctaattttcataagtttgtgtgttgtattctacctttttcttgcttatgtgatttttagatgccaaatgagttgtgtttttttgaaattcttcccatgtcaaattgaatatagtacttgtatttttgggcaatgctttgtgtagaatatcactaagaaatcacaaaaagctgaatcatatttgagacactaatattgaaaataagagtgtaactttctatttttaagataaacacacaatttatttctaagaataaatttctgagcaaacaagataagcaaaaaaggggagaagaatttaaatgataattaagtcatgataagctccaagttcagaaaaccttgatttgaaaaaaagtgaagttgaaatttcttggtggagtgtgtagaaatttgttttttgtgcaactcgtttggcttcaattctcatctgtaaactgaagggattggacatgacctccaagggtgctccctttccagctctaacatctgtgatgtaacagtacgtataaattcattattagaagcagatttcctattaggcattttaacaagctagttgcttttaaaagcagactcccagaataaagcagatatttagagtgaactggaattgaaaatatatacagaaatagctccgctttcccaatatttgttaaagcaattacatagtcaaaacttcttcaaagagaaagcaaaaatggtttaacttgcacctcaatctccaaagcagaaatgaatgacctttgattggctttgggtcaaaaatgaccaaatgaaggttgaccacattctatgcttaatccccttggggaagagtgtctatgacaacacaagctaaaaaatatcacattaaaacttggtcgttcacagcacccacctccccacgaatgtcttacctgcatctggttgggctaaaactccactcttctgcacaatgcaataataatttctcctgaggtgtctatctgaaaccactcctctctaataactccattttaatcaaaggaagaactaactcagggtttttgtttcattttttatagccaagcatgagataccttttggtaaatcccttttaatttaaagattgtgttactcttagctgctctttgattatctgacatggggagaaagtgatatttctcttatattcacatttatgtttctaatgtttaaaaagccaagccagcaagcaaaggaattgtaatatgatagtttgaaaacatcagttttggtgctgaacaatgcttcttctggtgatacatttgatgatacatggtgcttcttttggaaacttgccaaagaaatagttcatgacaaaatctcagatgcagctactcctccaactatgggaaaccttctcaattggtgaagccatcccataaaaagatgaccctaatggctaaggtggagaggcagggatggatagatgattcaataatcctagctctgagcaagactaatacagctaatacagacttcactcttgacctagcggactctacacacttcttccaggtccagagtcttgttcaagttctcaaagctggagcttgcaggtccccattacacacaagcagatatatcctaagtgcccgggctttcatctgccatttgcaattcacactcaggctttcccttccccatctagaacacaccttattttacactaaattggcgcaattattttttatggcatctaatcatcttaagcgggtaagaatggtgttctgactgcctcagcgccgagattctctcccctaatccgttgcaaccttcacagccggtggcctgaggcccagtcgttctcttcccttcctagtaggaatgagtacaattagagggtcaaagccgctgcttctgcagtaggcaacaaggtagtatttccattttattcatttccctcccgacattgtgaccgcgctgtgatgagctgcatctgtgtgcaccaagtaggtttgcaggcctcggagccacgccattttatttctggtggctctggtgagagacacttcaaacaacgctgtggagattttcttccggtgacagacacagactctcagtgttgctagatctttccaacgccagctagcgcgctgcggcgcgttttcctaagtgcggagaggcgcgaaggtgggtcctgttctcattggagcgtcgctttagcgcggccggcgttccgggactggctgtatttatttgttctaaagtgctcaggccttgttacggctcatttttccttcactagattttaaatacatccatctgagtgccaagaaggaggaaaaaaaaagtagagaggcggactgccaaccgctgggcccgccacgggagccggacctaggctcagccggaggcaggaggaggggctgaggcttcccgggcccgcagcacctggaccagagccggatgggcgctcctggtgtcccagctgaggcgaaggccctgggcggctttggccaggagggaggaaggacccattcggcacttcccaaagcctagtccgatggcccaggaagggcgtttagacccaaggccggcttcagctgcccacccgccagtctgggtcacaggctgctaaagggccgggcttgagggcgaggctgggagctgcggcgcccccacccgctgggtacacccccctgcattgcacacccttgagctggttgtgacttctgggcaccgacacctggaaccggttaaaagcgcctcctcctcaccgccagcctcggtcttccccgagccccctcgggctcccaagcgagctttgaatgtattaattaaataaagcgggcagctcttgaatcgcgccaatgcagtgcgctcccgggagcgtgaaagtcccggcctccgaatctgcaaaagaaatgtgtgaaaagagaattagtgaaattaggttagaccaataaaacgtgagggctccaatacccccctttctcgctcccccagcctggggctagaagggctatctggtctgatctattgtttcctgccctggcagggggttcattgtgtgataaataattccccctccattttcttttattcttaaaaaaaatgggtatttgcataatcagtgctttgatgtggccagaaatcggaggtttggtctccccaagtctgctattggtagcgaagcaacaaagctagatccagatctttcacttcgctgacagtgtgtggggcagattgtcagaaatagcagcgttaagctgctgccttcttttttaaggaccactttaatgattaaacttaaggaatgtccaaaaaaggagggatgaaagaccagctttctcatcactccacggacacaccccgccccccgcccccccccccatgcttcttattattctctgcagtttcttttccaaagcgcttggtttgggggatggtgcatctcccttggggccgccccacgtggcaccgagtgggcatcggcaggggtcccctagggccaaggaggggccaggtctgcaggagcggttctccttgcccccaacgcgtttttccttccccagtttgatttttccagccgggatggggttcatcttatggaggacgttgaagtgagtcgctctttagtccccgagtggaatgagtgggggttggggggttccctgggaacgcagcttggaggcagtttcagatggtccccgacaggagaggcgagcaaagaaattcagtcatccggaaagcagaacgcgaaagccagtgtggccggacctattatttccctgcaaggtggcgtgagtcgggaggatggaatggggaagaatcctgatggtgtgtgcgttacaacaaacgacttttttccccctctcggtgccagggtcgggggaggggagacaggggtggttctgtctgctttcgctagcattctctgcttctccagctgctcagagcgcgaagggggaaatgccaacttggattactgactgagaacaccgcgtgaaaggccaggcctccctgattacccgggcaggcgccggcttcgcgctccagcctggagaggtgtcaaccgcgtgagagatgctcggcctcccgggatccaaattggagatggaatcagagatggaagggggaaaggaggaggatccttgaaacacctgcacgcccacggtcccactccttctcctcctcggccccgcatctcaccgaactgaccccaggccattcttcagatgtcccagcagcttttggatcgcagagcttcagcggtagttagctcatcgtgaattc

SEQ ID NO: 662 - DNA, 1167 bp, Homo sapiens
cctcggaccccattctctcttcttttctcctttggggctggggcaactcccaggcgggggcgcctgcagctcagctgaacttggcgaccagaagcccgctgagctccccacggccctcgctgctcatcgctctctattcttttgcgccggtagaaaggatgacgcctcaaccctcgggtgcgcccactgtccaagtgacccgtgagacggagcggtccttccccagagcctcggaagacgaagtgacctgccccacgtccgccccgcccagccccactcgcacacgggggaactgcgcagaggcggaagagggaggctgccgaggggccccgaggaagctccgggcacggcgcgggggacgcagccggcctaagagcgagttggcactgagcaagcagcgacggagtcggcgaaagaaggccaacgaccgcgagcgcaatcgaatgcacaacctcaactcggcactggacgccctgcgcggtgtcctgcccaccttcccagacgacgcgaagctcaccaagatcgagacgctgcgcttcgcccacaactacatctgggcgctgactcaaacgctgcgcatagcggaccacagcttgtacgcgctggagccgccggcgccgcactgcggggagctgggcagcccaggcggttcccccggggactgggggtccctctactccccagtctcccaggctggcagcctgagtcccgccgcgtcgctggaggagcgacccgggctgctgggggccaccttttccgcctgcttgagcccaggcagtctggctttctcagattttctgtgaaaggacctgtctgtcgctgggctgtgggtgctaagggtaagggagagggagggagccgggagccgtagagggtggccgacggcggcggccctcaaaagcacttgttccttctgcttctccctggctgacccctggccggcccaggcctccacgggggcggcaggctgggttcattccccggccctccgagccgcgccaacgcacgcaacccttgctgctgcccgcgcgaagtgggcattgcaaagtgcgctcattttaggcctcctctctgccaccaccccataatctcattcaaagaatactagaatggtagcactacccggccggagccgcccaccgtcttgggtcgccctaccctcactca

SEQ ID NO: 663 - DNA, 14123 bp, Homo sapiens
tgcaacggaaacttttggctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttctttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatctaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttaaaaaaaaaaaaaaaaaaaa

SEQ ID NO: 664 - DNA, 4762 bp, Homo sapiens
ggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaaaaaaaaaaaaaaaaaaaaaaaaaaaaaaaa

SEQ ID NO: 665 - DNA, 3254 bp, Homo sapiens
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatattatgaaacagaatgactgtgatctttgatccgagaaatcaaagttaaagttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctcta

SEQ ID NO: 666 - DNA, 4005 bp, Homo sapiens
cggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgaccaatttatatctgacttggaacaccagccatcaggttcagcagagaaatggcctaaccacagtgtgctctcatgtccagctcctttctggagaatctagaggtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaaaaaaaaaaagaaaaaaaaag

SEQ ID NO: 667 - DNA, 4976 bp, Homo sapiens
gaagagaggacagagggagggagggtgggggaggacgaggggcgcgtggttttcccatctcatccctggaggaggggctggagcatccccggcagccaatcagggacaggctgggggggggaccgctttgaagaagtttgggggaaaaaagtttggaaaagtttctataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaaaaaaaaaaaaaaaaaaaaaaaaaaaaaaaaaaaaaaaaaaaaaaaaa

SEQ ID NO: 668 - DNA, 1678 bp, Homo sapiens
gcatatactgtcatcatcttggaaagaaaaggctgagaacgtaaaactgaggacagaggaggaaagcagggtgacccctgatgttgccctagaaaatggaaaacaaaacacagcaaaacagaaaaacagaagatctgactctgcctttagccaggaaaacagtttgggggagtaaaaagtattagggaaaagagtgggcattttgcctggaaaaaaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactgagctggcccagaggggtggaactgctgatgggatttccttcattcccttctgataaaggtactccccaaccctgagtcccagaaggagctgagttctctagaccagaagaggatgacaatggcaacaagtgtttggaagttccaaggtgtgttcaaagaggcttgccttgagggagggctggaatctgtcttccctgactcggctcctcaggtctttagcctccaccttgtctaagctttggtctataaagtgcgctacagaaaaaaaaaaaaaaaaaaaaaaa

SEQ ID NO: 669 - DNA, 4891 bp, Homo sapiens
tttccgagtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccgaaaaaaaaatcaaagcgggaagaaaatcagagggaaggttaaggttggctctggccaggattccaggcagcaggttggagtgactggtgggcctagatcactggtgtgataaaccccaattttcaccccggggggggtggggtacacagacacagggtgggggtggggagggacggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaagtgcactttttccccactttgaatttaaattgagaataaaggaaatggactcattgtaaaaaaaaaaaaaaaaaa

SEQ ID NO: 670 - DNA, 2884 bp, Homo sapiens
aaatcagggaggcgcagctcctacaccaacgcctttccggggctccgggtgtgtttgttccaactgtttaaactgtttcaaagcgtccgaactccagcgaccttcgcaaacaactctttatctcgcgggcgagagcgctgcccttatttgcgggggagggcaaactgaacgccggcaccggggagctaacggagacctcctctaggtcccccgcctgctgggaccccagctggcagtcccttcccgcccccggaccgcgagcttcttgcgtcagccccggcgcgggtgggggattttcggaagctcagcccgcgcggccggcgggggaaggaagggcccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaattaaaaaaaaaaaaaaaaaaaaaaaaaaaaaaaa

SEQ ID NO: 671 - DNA, 3720 bp, Homo sapiens
cggctgggcgaacgggctcggcgctcaggtggctccttcttcgcttctcccgatccccggcggtgccaggcacggtgccggctgccgagggaacgcctttgtgcccggtgctgggaacccgcgacggccgccacgcgccccggtccattgtttcgcttatctgggttccaggcaggtgcgggcggcgcgcggggtccgcacgtgtcaccccggcggctggggcgccgggacccgcgggcgccggcaggggcgttcccgggcgcgcggcggcgatgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttctatggaaataaattttgtatttgtattaaaaattaacttttcccttttatacagaatctgaaccaaatttaccttactttccttccaaaatatccacattcaggaatataggtgaataacaaataaggcagcatagcaaactgctcagactcaagccaaattgaggtcaacatagtatgccaaatccatagtaaggcaaatccacccccctaccccaatacttaacacacagaatactatgtgatatagaatgcactgaagacctacggtcactggtagtttgagccacaggccttcctcatgtaaccagagacagaatgggctacttgcaaaaacgtaactccttgtgtgtatattaaatccataaaatctctggcagtaaagccagcctgaagggatggcctcaccatcttagaatactgagatctcaccagaacactgtaagccatataaacagtagggaaagagtcagcaacagtgaaaccatctgtttaaaatgggcaaaagcgattaagggaaaaaaaacaggtgaatttgaaaataaaccagggtaaggtaaattctagaaataatagcatttgaaatgaaaacctcacttaagttcactagaacagtaaacaggagattgctgaattttttgaagacagcaatgacctcacctagatgactcaagtttggggaacatcaagattttgacgggtactataatgcttaatatgtccaaattttcaaaatgaagtttctcagatattatttctgccataggagctacagtgtagagtatcacataagtatcttgggctagagaaatgcagtttatatataccgttggatttttataataaagtttcccaagacctgttattttgccagaaaaaaaaaaaa

SEQ ID NO: 672 - DNA, 3063 bp, Homo sapiens
ggccgcggaggctcgggacccggctggccgcgcggcgccgcagccgccccctcccccacaccccctcccccccgcggcggcggcgcgagcgggcggcggctgtgcggtgcggtgcagagcggaggcggaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaagg

SEQ ID NO: 673 - DNA, 8159 bp, Homo sapiens
cgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagatttaaaaaaaaaataatgtatgcttttttgtttgtttgtttgttttaattgaccaaagtgggtactgctatttttgcagtgtgatgaggtccttttgtgtactgagagatggacaggggattttttttaatatacatatatatatattctggggtgggtgggaggatttttaacactttgcagtgtagctgtgaagcagtgcaccctgagatgggcctgggctgcaaagcgactgttctgcctactgtgacaaacttcaacttacacaggttcccctctctaacttcccacctgggttgcaagctgaactcattactggttttcataacaacacaatagtaagaacaagcaaacacaacaaattctcctggaggcagacttggcttaaaaaggcagacttggcttggtgatagtttttcttgaaagttccagatccacagtggagagtgagcctgtctcatatttggcaaaaatatttgttgaaatgtccacataggggatgttggatgtttaacacttttgagagtttaacacatgaatattctttctcctagaaaacacattagacctgttggagggagtctcccgtattccttttctgccacttttcgtccccatttcatttcattaatgataggatatgatttacctgtgacttactacttcaaatggatggcagtgcacttggatttttttttaatatccagaagattgaacagagggttgctattgttgaatgtatttggactgatagattaaaatcaaagttcaatttttaaggaacaaaaaagtaaatcctgttttcattttatctccccttttaaaactgagaaccagagcagaagggaaatatagaattttaagcaattaatcttcctgtggatgaattaaacccattagatgctgatgggatttttttaaggaatggtaccttaactatatatttgatttcgtttcccctgagggctagaggctgaatggaggctggttttattttgcctttccctcaccgcccagtcccattgagtgtattcattactagaaggaaaatctttcagaattggtgacacatggtaggctgtcttaaggagtcccctggcccccttcccctaggccatggcctaataaaataaactgtcaattgttctcacagcatatcatttaataatgaatactttagaacaatgcttatgggctggagaattgtatttgattagcccattcagtttgatagcccaaatgctgaacagcacagcgggatcctagcagtgcaagttcaaaagtaagtccaatcatttctgtgatactcgccctggtagcaaacagatcatctcagccaagctcttcatgtatctttgacctattaggtgaacaaatgaacctcacaggacacacagtattttttaaaggcagactcgctctcttttttgccagtgagcagttctagctaaccaagttacacactgtgggtattcctgcctgcctcttgaatacaaaggcctagttcaagtgttgctttttttatttcaaatcaattttttcttctttcctttttgagataaaactattaaaagtactactatatatataaaatctcaaatcaacttttcggcctcctcctcgtgtaccaggaagtatattctgacgaagggccccacttttgcaggtcttgcacgcccctcccttacccagaactgcagagcttcaggatggcgaaggtcacccaagggcatgagtagggagtggtgtctccaaccatcagttccgtggcactgttcagcctttgtgtgctgccctgccacccaccactcacagtgcctctgaagcgtgttacccctggagtgacgtgagcatttgaggcttgtctaaggaaaaaaataaaaggcagtgaaggagactgtacataaagacatggcaaaaatcttaattatagcaatatagttatcgggtaatgttcgggtgggcagctccattaaaaaatatgtgaatgaatctgtgaagctgcaagtagcgagaagagcgaaaggtcttcttaatgaaccgcctaccttgtagacagtaatttgtacactgtatagttttgttaagaattttttttaaattaaaattcccatgtttgtaaagctaactttttaacaattataatggaactatatgttgtttccatttttaaagtaaacaagaatattccttgtttagagactggacttgagttaaaactctccagtctcttaagttatgtattaaaaagaaaatctgtccatgttaggagttatttcacagattcctgtgcttgaaaagcataggatactaatcctttaaaaaagtgtaaatggagaaaagttatattttatgaaggttattttgttgtatttagtattggaaaagttggtttccagagcatttcagaatgtcgaagcaccactgtctttttattagtatatacggcctttagcaaaagtttttgtgattgttacgtgatggtatttaaggttaagtttcacagagcattcaggataggcagaaaactaaaacagtgctatgtctcacataacgtgtcctcagggagcagaatcttggatttgtgacttgtagcttcataaggactcaacgaaagagattgcacagggacatcttcagcggtgtgacagcaggacatgttctttacctagattcaaattctatgtactgtgtgaaatgatgaaggctgcagaaagttatcccatattcagtgtacagtattcatttttaatgaaacaactctacaatattgctggcagataggccccaagcatgacattcaatatagtttacatgttcctgtcaaggtcttttgttaacattaaccagctgcatgctttctggactttaagaaattgggtttctatagaaaactttttttttttttttttttttaatgtgcaggctattcaagttcaatagtaaaagctcaaaaatgaatgttctactccatgctgaaggagctgaaagctgccttcttcatattttgcactttctggtagttcccctgttttttctaattccctaaaattgtgtgggtggagtggagccctgcagttggggggtaacatggaccactgattttgccctttgaccctgcacaatgacctttgcatcagccaaactcattgccatgacaactctttgtactgtgtccgtgccacagatctgttggtcacattgttaatagtaaaggggacaagttggagacggtcaatttttacattttttgttgcaattttttcttcaatggttgtaagtagtttttttttttttttaataataaaagggttcactagttaatactctagaaatatctgtgtgttgcaattcaaatgtatgttgagattgtgaaaagcgcttcagtgccactagcttaccggtacactagactaagcccttgatgacttattgcatgatacagtaccaggaacaacaggtggcctaaatacatgaaaagcagtgtaagctagtgacactaaagccagtcttgtattactgtatttttgacagaatggttttgaaaactgtgctacagggactgatgtggcaaatatatctctttatgcagaaggaagtctttttttttcttttttttttttttaagaagtatggctttttatgcatccttcatcgagggcattgaagttgcatggactgataaaagttgatgcaaaacaagaaagaaacaaacaaaaaaaaaaaaccagcaaaatgtttaccaaaaaactcaaacaaatgagcagtgcctgttcaatttcacagtctctgttgagttcagttgtaaatatgtttcaaatgacattttcttgggaaaaaaaatctctacaacattgtagaatgtgaggggtaactacatcccaggcataggtttctcaaagctgcagtagattatgtcttcatcaagctgttaatttgtgcttatatcatatagaacttttagcatcctgggaagagctgcccccacctcaatgatatttctctgagaacaacttttgtaggactgtgtgtttctttagatacatttagtacaactgtaggtgacgagtagtcagttattgcttgctagctacacaccagggttgatccattttaaaacttttggcattttgtcctcatgggccataaatacagaaccttgtattttaattaaatttttttacaaaaggaggcacatgcacaatctccatgtaacaaacctttagcagtaggatgtattatacgacagttacttaatttctagagttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgacttaatgtgattgttactgttatatccagcctatactgctagcagctgctcatactgcagtcaattactggaagcggatatatttcctatgcaaaaactgtttaaacaataaaatgagctatgctacaga

SEQ ID NO: 674 - DNA, 2185 bp, Homo sapiens
aatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctcta

SEQ ID NO: 675 - DNA, 2104 bp, Homo sapiens
acgtagcgcggcgctcggaactgacctactaacacacatctctccgcgcggccacggcgcccgcggacccggcgcgcccgcccgcctcccgcgccgcgccctcgccgccgcccgcctcccgccgcggccccggaggcccggcccggcccgagccccgagcgccggcggcccgactcccggccgcccctttctttctcctcgccggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggagctgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgagaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaaaactggagttgttgaaatgaaagacagtggctacaaagtttctgacccagagaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacacagaaaaaaaaaaaaaaaaaaaaa

SEQ ID NO: 676 - DNA, 5576 bp, Homo sapiens
gcggccgccgcctgccgggcctcccctcgccgcggccggccgccgcgctcccgcccgggcgcccagctatgtactccccgtactgcctcacccaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaaccccaccctccacacagccggagctgccctagggagcctggagggccagcttgtaaagatgatggggtttagatccctcaggctctcccctccagactccgcccttccctccctccctccctccctccctctctgccaaggctccagcttcttcccccagctgctcccgaccaggagggggagagcagcctccacttaccccaccccacccttgggctaaaagcccccaggcgggcagggggtgacccctggagctagttgcgtgtcccagaatggagggtgttctgacaccccaccctgagccgcaagagcagtcctggggccctggacccctctgtacagtccgtaggaaaaagtcggaatgctctcgacggcctcgtcccagcctgggacaggccccctttcccctctctctgcaggccaggagggcctccttcctgccacgagggaggggagtcgggccccaggtcgcccccgcccccagccctgcatgcaggtgccctcgctccgccccatcagttcctgcccctgcccctcatgcagactgccctgctggggccgggccggagggtggagcagaaaggggaccccggagccgagcgaggaggaccaggcagccgccgctgccgcgctaagccaccacctgcgcttaggtaggcgtcctgctcgccgactttcagttccttgggagggtgttgggtgtcgtccttttcaaaagtgttttggagctttctgtgccccccgactttcccccgcctccccgccccccacgtggccacttttctctggattttagctgtaatgtctttactctttatttaggggtggggcattcattgtttgggtcttttgctgttggaatgggaactcctcctccatttgagcaacttgggaacaatttggtaacacaccacaggaagtagctctcccccccagccccctcctccctcaagggagggttggggggcctgtccagagggtcttcagaagcccccctgggagggaggggaggatgagcacgcccagctcccctccagggtgtgacttggcccctctggcttgtctttctgtgccttactcctcctcctgcgtctcccgttcctggccccttcttgagtccttgtgcctctctctttctctctctttcttaattgtatgaaaacacaaagcacaggtcaggatcctctgagagaaaatcaacattgcaccacgtaggggtgggctatgggctgtatttattgtgaatctagtttgtgaggctgtggccccgagctggcggagggagggaagaggagggagtgacgggaggggaggaggtcagcgacctggggccgtagcggcaggcgaacggtgcctgctacccagctggaagccacaaggtggctggctccaggggcggcttttgttggaagttgagtgaagccctccccctgtcctcagcgtgcagccctagaggaccccagggctgaggggcagtggatcctgcgggagtctcccggggcgtggggagtaaggccccgggggtggggggccgggtgggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccctccctctccgccccgagcgcccttctttgagccagacgccaacttgaccctcaccagcattatcaggagcgcgctcagcaagttggtagtttcctcccccctttcccggcgcccctcccgcccccattcaacatctctcatcctatccccgaccccctccggggaacaccgggaaggctcgacgctccaggacaggaccagccacgcagacaggtcgatttgcccaggcccgcgcccgcacgcacgcacgcacacggccccgcacacagccccgccccaccccgcaaccagccctgtcgactgccttatacacccgcccccgcgctggccggccgacctagtgccttgttctcacccccgtgctggcggagcggacgccgcgctctgggtcccagaggggccgggtggctcagacgacccaccactcccccaccctgaccgtgctgaacagacccccccacacgagagaaaataaaggagcaataaagtcacgagaactttcgtcccccaatcgagagcccgaggggcaccccagccccgcctctgctcccccccaccccacccaccctcggggcgcccccctccccccgcaagccagcctgggccagccccgcttcggcccctcccgggagatccgtgcgcccgaccagcaccagcatcgcggaccgcaaaggccgcccgtcccgtcaaacaagtttcttcttaggctaagaaacgcagtatatacgagtatctctatatatagtactaatggatttggtgtgcttcccccttagcgtccccctccctctgctcctcctccttcagcctggtctccccctcttctctgccctccacccccgtctctgcactgagatacataagaaacaagggtagtttactgtctgttttgttttctgggttttcagtgtcctagcggaatgcaagtaggcagccagcccgtctgttccctctccgccccgccccgccccgcccccgtcactgcgcttctgttataccatctttgcctgactctctccggcttctccattgaatggctaatgtgtatgtgaaataaagaaataaagaaaaacaaacgcga

SEQ ID NO: 677 - DNA, 1198 bp, Homo sapiens
ccggcaaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagaaaaaaaa

SEQ ID NO: 678 - DNA, 2581 bp, Homo sapiens
aatgaatgaatgaatgaatgagtgaatgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggacccgcttgggcggttcggctgcccacagtaaccgctgggtggacctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacgctggtccacctggcagtgattcatgaggccccagcggtgctgctctgttgcctggctttgctgccccaggaggtcctggacattcaaaataacctttaccagacagcactccatctggctgtacatctggaccaaccgggcgcagttcgggcactggtgctgaagggggccagccgggcactacaggaccggcatggtgacacagcccttcatgtggcctgccagcgccagcacttggcctgtgcccgctgcctgctggaagggcggccagagccaggcagaggaacatctcactctctggacctccagctgcaaaactggcaaggtctggcttgtctccacattgccacccttcagaagaaccaaccactcatggaattgctgcttcggaatggagctgacattgatgtgcaggagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgttaaaaaaagtttttcccttctagagctgttttgcgcgcatgcatgtctgtgtgcattggggctttttagacaggcctgccctgtgactttgtggtagaggcagagagaaggaaattgtcccctgagcacggtagggccttgctgggtggggtcagaggccagtagttccaggcctttctctgtgtccagcacagacccttgtccttgctgtggaaatgatgagggatggagggacaagaggaagaatgagaggacacacgccctggagccctcaccactgccctgggggttgccatctggaggagcctggggataagggtaacccagggaggctgggcacgagggagctgactccacgtttttccccccgttcctcaccttcgagggccctgctaggtcacccctatgctggcatgaagagcatggggcaataaaccagcacagtctctgaccacttggagcgtctcatccagtgagagagacagccgttaaaagcataaacatccaaataaagatgcctttccaagtt

SEQ ID NO: 679 - DNA, 1510 bp, Homo sapiens
gcgccatttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcccgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctcaaaaaaaaaaaaaaaaaaaaaaaaaaaa

SEQ ID NO: 680 - DNA, 4519 bp, Homo sapiens
cgcggcgatccgagcatgagcctggagcgcgagcttcgccagctgagcaaggcgaaagccaaggcgcagagggccgggcagcggcgcgaagaggccgcgctgtgccaccagctgggggagctcctggccggccatggccgctacgccgaggctctggagcagcactggcaggagctgcagcttcgggagcgcgctgacgaccctctgggctgtgccgtggcccaccgcaagatcggagagcgcctggccgagatggaggactacccggctgccttgcagcaccagcaccagtacctggagctggcacattccctgcgcaaccacacggagctgcagagggcctgggccaccatcggccgcacccacctggacatctatgaccactgccagtcgagggatgctttgctgcaggcacaggctgcctttgagaagagcttggctattgtggatgaggagctggaggggacactggcccagggagagctgaatgagatgaggacccgcctctatctcaacctgggcctcacctttgagagcctgcagcagacagccctgtgcaacgattacttcaggaagagcatcttccttgcggagcagaaccacctttacgaggacctattccgcgcccgctacaacctgggcaccatccactggcgcgcgggccagcactcccaggctatgcgctgcttggagggtgcccgggagtgtgcgcacaccatgaggaagcggttcatggagagcgagtgctgcgtggttattgcacaggtcctccaagacctgggagactttttggctgccaagcgagccctgaagaaggcctacaggctgggctcccagaagcctgtgcagagggcagccatctgtcagaacctccagcatgtgctggcagtggtccggctgcagcaacagctggaagaggctgagggcagagaccctcagggtgccatggtcatctgtgagcagctaggggacctcttctccaaggcaggagactttcccagggcagctgaggcttaccagaagcagctgcgttttgctgagctgctggacagaccgggtgctgagcgggccatcatccacgtgtccctggccaccacactgggagacatgaaggaccaccatggggccgtgcgccactatgaggaggaactgaggctgcgcagcggcaacgtgctggaggaggccaagacctggctgaacattgcactgtcccgcgaggaggccggcgatgcctacgagctgctggccccgtgcttccagaaagcgctcagctgtgcccagcaggcccagcgtccccagctgcagaggcaggtcttgcagcatctccataccgtgcagctgaggctgcagccccaggaggcccctgagaccgaaaccagactacgggagctcagtgtagctgaagatgaagatgaggaggaggaggcggaggaggcggcagccacagcggagagcgaagccctggaggccggcgaggtggagctctcagagggcgaggacgacaccgatggcctgaccccgcagctggaggaggacgaggagcttcagggccacctgggccggcggaaggggagcaagtggaaccggcgaaacgacatgggggagaccctgctgcaccgagcctgcatcgagggccagctgcgccgcgtccaggaccttgtgaggcagggccacccccttaaccctcgggactactgtggctggacacctctgcacgaggcctgcaactacgggcatctagaaattgtccgcttcctgctggaccacggggccgcagtggacgacccaggtggccagggctgcgaaggcatcacccccctccacgatgccctcaactgtggccacttcgaggtggctgagctgctgcttgaacggggggcgtccgtcaccctccgcactcgaaagggcctcagcccgctggagacgctgcagcagtgggtgaagctgtaccgcagggacctggacctggagacgcggcagaaggccagggccatggagatgctgctccaggcggctgcctcgggccaagatccccacagctcccaggccttccacaccccaagcagccttctgtttgaccccgagacctctcctcctttgagcccctgcccagaacccccctctaatagcactagactcccagaggcctctcaggcccatgtcagggtctccccagggcaggcggcaccagccatggccaggcctcggaggagcaggcatgggccagccagcagcagcagcagctcagaaggcgaggacagcgcaggccccgcacggccgtcccagaagaggcctcggtgctcggccacagcacaacgggtggcagcctggacgcctggccccgccagcaacagggaagcagccacagccagcaccagccgggcagcctaccaggcagccatccggggtgtgggcagtgctcagagccggctggggcctggcccaccgcggggccacagcaaagcccttgccccccaggcagcgctcatcccggaggaggagtgcctggccggggactggctggagctggacatgcccctgacccgcagccgccggccccgcccccggggcactggagacaaccgcaggcccagtagtacctctgggtcggacagtgaggagagcaggccccgtgcccgagccaagcaggtccgcctgacctgcatgcagagttgcagtgcgccagttaacgcagggcccagcagcctggcttcagaacctccagggagccccagcacccccagggtctcagagcccagtggggacagctctgcggcaggccagcccttgggtccggccccgccccctcccatccgggttcgagttcaagttcaggatcatctcttcctcatccctgtcccacacagcagtgacacccactctgtggcctggctggccgagcaggcggcccagcgctactaccagacctgcgggctgctgcccaggctcaccctacggaaagagggggccctgctggccccacaggacctcatccctgatgtgctgcagagcaatgacgaggtgttggctgaggtgacttcgtgggacctgcccccgttgactgaccgctaccgcagggcctgccagagcctggggcaaggggagcaccaacaggtgctgcaggccgtggagctccagggcttgggcctctcgttcagcgcctgctccctggccctggaccaggcccagcttacacccctgctgcgggccctcaagctgcacacagcactccgggagctgcgcctggcagggaaccggctgggggacaagtgtgtggctgagctggtggctgccctgggcaccatgcccagcctggccctccttgacctctcctccaatcacctgggtcccgaaggcctgcgccagcttgccatggggctcccaggccaagccaccttgcagagtttggaggagctggacttaagcatgaaccccctgggggacggctgtggccagtccctggcctccctcctgcacgcctgccccttactcagcaccctgcgcctgcaggcgtgtggcttcggccccagcttctttctgagccaccagacagcactgggtagtgctttccaagatgctgagcacctgaagaccctgtccctgtcctacaacgccctgggagcccctgccctggccaggaccctgcagagcctgcccgccggcaccctcctgcacttagagctcagctccgtggcagccggcaagggtgattcggacctcatggagcctgtattccgatacctggccaaggaaggctgtgctctagcccacctgaccctgtctgcaaaccacctgggggacaaggctgttagagacctgtgcagatgtctctctctgtgcccctcactcatctcactggatctgtctgccaaccctgagatcagctgtgccagcttggaagagctcctgtccaccctccaaaagcggccccaaggccttagcttccttggcctgtcaggctgcgccgtccagggtcccctgggcctgggcctgtgggacaagatagccgcgcagctccgggaactgcagctgtgcagcagacgcctctgcgctgaggacagggacgccctgcgccagctgcagcccagtcggccgggccccggcgagtgcacgctggaccacggctccaagctcttctttcggcgcctctgaccctggcgctgcctttccccaccctcaccgaagcccctaataaatgaagctgctggccgggcgcggtggctcacgcctgtaatcccaacactttgggaggcccaggcgggcggatcacgaggtcaggagatcgagaccatcctggctaacatggtgaaaccccgtctctactaaaaataccaaaaattagccgggcgtggtggtggaagcctgtagtcccagctactccggaggctgaggcaggagaatggcgtgaacccgggaggcggagcttgcagtgagccgagatcgcaccactgcactccagcctgggcgacagaccgagactccgtctcaaaaaaaaaaaaaaataaaataaatgaaaaaa

SEQ ID NO: 681 - DNA, 5063 bp, Homo sapiens
gctgtttagctgtaattagggtgcaaggataaggtgtaagaactggctggaggttgaatgttttcctggaggagtgttagcatcaactagatccctggaatttctgcctttctgtctcaagatgcatgtctttgtccagagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagaggccacgttggatttacaagaacaattttcttttgaagatctcagctcatggcttccgagctctccagcacgttctcctagtcctgcggtgcccctgcgggtggtgcccacactttcaaccacggatatgaaaactgcagataaagtagaactgggggacagtgacctgaagataatgttaaagaagcaccacgagaagcggaaacatcagccagatcacccggaccttttgacaggggacctgactctcaatgacatcatgactcgagtaaatgctggcaggaagggctctctggcagccttatatgacttggctgtccttaaaaaaaaggttaaggaaaaagaggaaaagaagaagaagaaaataaaaacgatcaaatcagaggcagaggacctggccgagccgctaagcagtactgaaggggtcgcacctctctcacaggccccctctccgctggcaattcctgctatcaaggaagagccccttgaagacctcaagccttgccttggaatcaatgaaatatcttccagcttcttctctcttctattagagatcttgctgctggagagtcaggctagccttcctatgctagaggagcgagttttggattggcagtcatcgccagccagctccctcaacagctggttctctgcggcccccaactgggctgagttggtactaccagccctgcagtatcttgctggagaaagtcgagctgttccttccagtttctctccatttgttgaattcaaagagaaaacccagcagtggaagttgcttggccaatcccaagataatgaaaaggaattagctgccctcttccagctatggctagagaccaaagatcaggccttctgtaagcaagaaaatgaagacagctcagatgccacaacacctgtccctcgggtaagaactgactatgtggtgcgtcccagcacgggggaggagaaacgggtttttcaggagcaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttgttcgggacgctgcggctcgactgcctaatggagaaggcacacgggcagagatctgtgaactgcttaaggactcccagtttcttgcaccagatgtcaccagcactcaggtaaatacagtagtgagtggtgcactggatcggctacattacgaaaaagatccctgtgtgaaatacgacattggacgaaagctgtggatctacctgcatcgtgaccggagtgaagaagagtttgagcggattcaccaagcacaagcagctgcagctaaagccagaaaagctcttcagcaaaaacccaagcccccatccaaggtgaagtccagtagcaaggagagctccataaaggtccttagcagtggcccttctgagcagagccagatgagcctcagtgactccagtatgccacccaccccagtcacacctgtaacccccaccacaccagcattgcccgccattcccatctcccctccacctgtatcggcagtgaacaaaagcggcccttccacagtctcagaaccagctaagtctagctcgggtgttcttctggtgtcttcaccaacaatgccacatctgggaacaatgctttccccagcttccagccagactgcacccagttctcaggctgccgcccgggtcgtgagccactctggctctgctggactgtctcaggtgcgagtggtggcccagcctagccttcctgctgttccccagcagtcgggagggccggcacagacattgccacagatgccagcaggaccgcagatccgggttccagccactgccacacagaccaaagtagtgccccagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaacatcatcaagcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcaaagtgactcctgacctcaagccaacagaagcctcaagttcggcttttcgcttgatgccagctcttggcgtgagtgtggctgaccagaagggaaaaagcacagtggcctcttcagaagcaaaaccagctgccacgatccgcatcgtgcagggactgggagtgatgcctcccaaagcaggccagaccatcaccgttgcaacccacgccaagcaaggggcctcggtggccagtgggtctggaactgtccatacttcagcggtgtccttacccagtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcaggaattaccagttacgtccaacaagccagagttctgagagtaagacccccagggaaggcttaccagttgcagagtgcacacagcgaataggctggttctccatgaggattgtattttttggcttctggtcttctccatgactagtggtctggataggagttttgtgtccagaaaattttatgtaatttatttttttaaagaacctgttgtacatctttctcaaatacaaacttgggctttagctgccccctccactaaaccgatgacttacttttttgactagaatgagaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagataggggtgttgggatcttgattgtggccgccccccccagctttacctgcccactttgtccttcttggcaagcctgttcacatggacgtccagagccagtggacagagaggaggggacggacagcagaggtgctgcttttgcagcagaaactttgttgcagttcagagtataccttctgctctgctccagagcaagagttgcaaaccaggcccttggggctggccatttgtttttgtaaataaagttttattggaacacagcccaaaaaaaaaaaaaaaaaa

SEQ ID NO: 682 - DNA, 4629 bp, Homo sapiens
acgtgacctggtgacagtgctgacttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtagagctacagtgtgaatgtggacgaagaaaagagatggtgatttgctctgaagcatctagtacttatcaaagaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataagggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcagggggaagtccgtttgtcctcctaccacgctgacaggtgtgcttgaaagggaaatgcaggcacggcctccaccaccgattcctcatcacagacatcagtcagacaagaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaactttaaaaaaaaaaaaaaaaaaaaaaaaaaa

SEQ ID NO: 683 - DNA, 6236 bp, Homo sapiens
cattttgctaggcagcggcagtggcggcggcagcggcggctggagcctctgattgggtttcggagtccggtactggagccaatcagcgcgggcagcgaaccgggggagcgaggcacggagtgtacctcacagccttctaggatctccagagtggacaggaatctcacttggagggaccatggagcagtatacagcaaacagcaatagttcgacagagcagattgttgtccaggcaggacagattcagcagcagcagcagggtggtgtcactgctgtgcagttgcagactgaggcccaggtggcatccgcctcaggccagcaagtccagaccctccaggtagtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaaatacagttggtcccacctggacagatccagatccagggtggacaggctgtgcaggtgcagggccagcagggccagacccagcagatcatcatccagcagccccagacggctgtcactgctggccagactcagacacagcagcagattgctgtccagggacagcaagtggcacagactgctgaagggcagaccatcgtctatcaaccagttaatgcagatggcaccattctccagcaagttacagtccctgtttcaggcatgatcactatcccagcagccagtttggcaggagcacagattgttcaaacaggagccaataccaacacaaccagcagtgggcaagggactgtcactgtgacactaccagtggcaggcaatgtggtcaattcaggagggatggtcatgatggttcctggggctggctctgtgcctgctatccaaagaatccctctacctggagcagagatgcttgaagaagagcctctctacgtgaatgccaaacaataccaccgtattcttaagaggaggcaagcccgagctaaactagaggcagaagggaaaattccaaaggagagaaggaaatacctgcatgagtctcggcaccgtcatgccatggcacggaagcgtggtgaaggtggacgatttttctctccaaaggaaaaggatagtccccatatgcaggatccaaaccaagccgatgaagaagcaatgacacagatcatccgagtgtcctaaccccacgccatgtgatggagctgatcaaggtcatgtttctcactgttccaggaaattgatcaactcttccaatgggacattgatgatcacattctgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagacagcatttatccctctggtgggggaatctcacactgactaactgaatggacgctttgtattcagagatggcttccaggcaaggaagttctatcttgtgatacggaaacaataaattcctgagatacattcttccaatctgtggtaataataagaattcctctctgcccagatggtaggttgatatttctggactctagccaagaaaaagctaattctggggatagaatgataaaagactcaagcactaaaaatatacattgccgaatctctttttctagctttgaaaagttgtggcctgcttgtccctctgttgactggtcatctggaccatcgtacttgctgtggctacttctaagacaatgtagagggttattaaaccttgaaactgcctttcctaagtagagaacaagactattcaacaacttctttgctgaagcactgaggagatttgtaatactcctaaaggaagggccaaactagagattttcaatcatagactttgtgacagcatttggggaactaaaagattcatgtgtttcagcctagtgggagagagtgggggagaggaagagagagagagagcatgtatacccgtatgttatcatagagcacgattctccagtggatggatacctggaatggatcattaagatgaagagagtaattcacatttactctagaacctttaacaagcactgaaaggaagaagcctgagatttgatccttgacaatttctggaaagcactggtcagtcacactgtcctggacagagtccaagttacccactaaagcttgaggtggatgttggcttcactcctgcagcacaatgctggccctagaaagcgagcattttcattcttcccatggcagctgattctttggtgccagttttcatgttttctccataggccttgtgcagaaaggttttctcattgcatccatactgtgagaataaactgcagactgaaagaaacatgcctgcagggtcaggaactgggccactgttcccagaacgggttgtgcctcagaaatctatttctcttttagatgttgaaccctgagagaactaagatgatatttcagaagagttggctgccttctctggaaacaaggaaaacccaataattccgaggaacattgggggttaaataccaagaataaaaattggttcttctttgacttcagcttaactgtattaagacagaaattaagccctctaaaaacaccacaaagagagatgattgtaatgatagaaatagaggtacagagctatgcaaaggaaacaggaagtgaaatattcctagtcccagggatctggtaatcgctcctggcttccagatgtcaaaggactgatcctttggtaagctcactagaaacttctagctctacaagagtttgggatattaatgttattcagtaagtcccaagtttttcagagaatagattactaacaatgaggaatttatattccttggttaatttaggagtctaagatgcagagttcagaaagaaattactcagacctaactttgagtgcttaagctgccaacagttagaagatgctatttatttgtgtctgtaagtttgtacatagtaatgccagccttgttgctgaattttttatttggggggagatgactttgaattttgtttgaaatgcttcagttgtcattttgtcattgcatttcaaatagctcatgacccttttcttgtggtcactttggcacaccatagtagcccacaaagtgggggcagggtattgacatttggattttttctttgatactagttcttttattcatttttatttgtgactgtagtgataactttacagatggagaaagagtgaatggatgaatgaataattggtttaatgcctagttatgcaacttgagtgcttttttttttttttgcaggataattttaagtgtatatattttaactgcactggtacattgaacatgtcagtgtcgatgccactggaccaacagagcattttgtggctatagggtgcctgataataatgtcttgatttttctttgggattcaactatatcgaaggtttttcccccagcagtatgggggcgtacaggtgatcgatcattaatgtcattgcaattgttattttttaaaataaatttataaaaataaccgaaaagtaatgtgacttttgaggaatctgcaactcctgggttctagtttgtgtttccagtgttgaaattttgatctcccccgacaagacttgtctgcatggacggtgtctctgtaaacagtatcaaacttgtaatgtctgagcctcttagctttatctccccttaatttcttcccttttggcccttccaccctgttgaggagattttttctgtcacctgcaggctgatcatacatttgatgctactactgaaagtgtttatcaaaatgtgatgaagtaattccatgaggaaaattagccgttatcacaaaaacagccttaagtattgtagaatttcaggtagtgaagatgtactatttacgttttgttagattttgttttggcagaagaccaaaacaaaagtacttttctgattgttaaaaatccacagcatgctcaccttgttactgttttaccttacggtcgctgggaatctaagcaacaaagactagaagcctccgatatgccattatcaacacacaagagacaaacagcccgaggaagcactcaatgatgagagcagtagacctgccctggcagatgagagaggagaaactctccacaatgaaggaaaagcactgacagtatttgatagctttagtcaaactgtgcttgagtttggcttagatttatgccagtggaacctgtccttaccaaattcagagatgacccaagattctactctgtggtatgagggaaagacctctcgatatttatctcacaccaacggctttatcgtaggagcgtcttcgcctcccccgtttccagtagaaaagacagctttgctcctttgaaagcgcagaccgccgcacctccagccccttctccccggggaagtaggccccgctaagaatgtgggaaggtggtggggcggcgactgaagtcgcttccgattggcgttgtcccaaggaagcctgcgcggattgatcggcggcaggcctccaatagagcctgctaggcggattggctgctacgcggctgggccctgtttccggtacctaggcgggcagccatggtgaccggcgagcggcatgcgacgccgcctctgtggcctgtggaggcccgcttggcggcgctgcttcccgacctactggtctttcggaagcctcggggatgggaacccgagctcgccacggcccagggcgtcctcctaggcgtccatgtgacgggtgagggcgacggccggcacttgcacttaagtctcctggcctgcgggagaggcggccgttgggtctaagcccctggaggcctcgacggttacaggcctagcctcccgcgagctaaggcacagtttaacttcgtgctgcggcttccttaggaaactttgagtatcttcgttttagcgtgggaggacatcttttgggatgaaccggctcagtccttgagctcaccccaaagatgatgaaattgaaactcagaggaaaggatttttacaggaccacgccccgggctttgaacccgtttttcccaaccccgagcattttctattaagcgttctgtttcaattattttattcgttcagttaattcgttcttggcgtcataagtatatgcccgccgttgttctggccgtagctatctagcagccactccgcgagtcgttcatttaacaaatacttactctgtgtcagggatatgaagatgggtaataccaggtgcctgtcctcactgtgtgagtggttctctagccagacatgaggagggatcctattgtttcccatagctaggcagcctaagagagtaggggaaagagctggctccagatgaaaagggcaccatctccagctcttggaagcagagagggtggtcctttggattcccagtggcagcagcaaccaacctggcccttagtagtttctaagttacaccatgttaatggataaaggaattactcagcttgaagggatctgtttcctttacactggcctgatgtgtggggagaaaggggccaaaaagtttaggatttggagttaacatcgtaatttctgctttgttggtcagggtttacagcattaatggacaggttcaccctgacctacaagtcggaacgtgacatggacaaactggcccatatcttcagttattacattagtgacatcgtggagcgtgagtgatcattgtagggtaacaaggtgtggtgctgggctcctgggggtttataaaagaagggggccagaagtactttaaaacaggtaccaaagggtcattcctttagcatcattcatctttggtttcttcaagttgccactgaaaagctagacctttgcctattatctgctaatctacccagtctcacattctattgactcattgttcaaagggggggcaggaggagctaatttcctttgcacatttgtattttatttcaaaataaagtattctcttctaacaataacgtaaaaaaaaaaaaaaaaaa

SEQ ID NO: 684 - DNA, 3482 bp, Homo sapiens
ggagggaggggaggccgagtcctggaagcggagctccgcgctgggactggttccttcgcagccattttctgtccaaccaaacagccgattggagacgggagccaaccagggctgcattggaggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacattaatagtttaagcagcatcatttttttaaaaaatgtaattgaataagtgtgaatgcagaagcaaatattgtctgccctgttaaacttggtgcccattaacagtgtttacactgttcatcgtgcctgttaatgtagttttagttactggagcttttttaagactagatttggttttgagttacatttttaagaatgtgggaatatatttaagtttaatgtagtcctagtgctcttgaaatggtgcccctttcatttggtacatgattttttttcaaatcatatcttcaagtactatagtattctcttacagaagaggagttttatagtctgatggtaaatgtcttcattttacctttttaattgaaatgtcaagtttcctgttacactatggaaaccaagaaacatcagacatcattgcgtgtacagaccttttgcatgggtgagtggatgaaatggagaacagagtgagtgctgtgaacggtgtgaaatagaagccaacttctagtatgctgtcttcatctctgcaataaactaaacgtaaataatgtaactttgtataatttagtagtatgtacttggattgtttctttttgaaaagtgaggatttgtattttctcatctattctttttggtgttaattaacttgagggatttcttttttaagtttttaatatcaaaaattgctattgtatagtttgcctaaaaggaagttggagtgaatatcatctttgaaggacactcaaatttataaggtagaagcaatttcccagatataggctgaacagaaacatttactttgccagaaggagcctttaggagtatatgtgggctaatcagaggttaataatgtcctcatctcctactctccatttaaaaaacaaacttcattgtagtaaattcaaataggaaaaaatgggggagtagttaagcaaaatcaacagtcatcctactatgttgaaagaaccaatgttaatattttgataaatatcatttgtccttttactttgctaaatatgtatatttttataaaaatgggctcatattgtgcataccattttgtaacctgcttttttcacttaacaatatattgggaacatcttttccaggtcatgcatagtcttctgcatcatttttattggtttattattctgctgtatgactcaatcataattcatttaatcttctattggatattttgactatttacatcttttcacagttataaacagcacttcactgaatcccatgtacatccatgactgttttcttaaattctttgaattgctgggttaccaaatatgcaaaattttaaggcttttgatacttcgttatgagtgtatttttgagatattttccacttgatccaagcagtgtgtcactatataactgataaaagcacttggtctttgattatcagatactgtctctaaaattattttaaagattaatatttgttcaagtagagaatgaagataaaaaaggaatttgaggccaggtatggggtgtctcatgcctataattccagcactttgggaggccaaggcaggcagatcactttgaggtcaggagtttgagaccagcctggccaacatggagaaccccccgtctctacaaaaaatacaaaattagcagggtgtggtggtgcacacctgtagtcccttactccctggtggctgaggcattatcccttgaacctgggaggcagagcctaaagtgagccgagatcgcgccactgcactccagcctgggtgacacagcaagactcttgtctcaaacaaacaggaatttgagtaaattttaaattagtatatactacaacaaatttccaaacttcataatttgctagtagtgctaactaaaattttacaccaggtaaaatcaggtcaccttttttatgtattgacttcattgttggacttcatactctgatgggaaagaaaatggacattctgaatgtgtcaggtgcataatatcctaatttatgcttgtcagagctggggtctctgtcttccttggcccatgttgcatttaactgaatgtcatgttttctcctctggaacttcttatgtatgcaagctcccatgttaacctatcataaaaatgttttttataattttgt

SEQ ID NO: 685 - DNA, 2105 bp, Homo sapiens
agatctcattccgcctccctctgtcgtcgccccttcccaattctcgcgagacctcaaggagcacagcttctgcgcaccgcacgatactgggagtccaggcgccaagggagggggaagggaaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataaaaaaaaaaaaaaaaaa

SEQ ID NO: 686 - DNA, 2594 bp, Homo sapiens
gtgtgtgtctgagggtgtgtgtgtgagtgtggctggccccagtacctggccaagcccaccacttccacctgggccctacacccccacaatgtgtacccctcttatctgccctggagcctgtacagccatgccacgctacccctgagagtctagaaagctggtcactaactttgcagacggatgagccttgagcacccagaggagactggggctgtcaacgctgccccttgtcctgccggcttggatcccctgacagggtccttctaggcttcagactggcaccctgaccatggaaccctgaagtggcagtgacttctagagctcagtggcagaccccacgacccttcctcccccttcctccccctcccaccaccagctttcaagctcccagagggaggggtggggaggggatcctgatctcacagggcagggggcttccatcatgatgctcaactcagacaccatggagctggacctgccgcccacccactcagagactgagtcgggcttcagtgactgtgggggcggggcgggccctgatggtgccgggcctgggggtccgggagggggccaggcccgaggcccagagccgggagagcctggccggaaagacctgcagcatctgagccgcgaggagcgccggcgccggcgccgcgccacagccaagtaccgcacggcccacgccacgcgagaacgcatccgcgtggaagccttcaacctggccttcgccgagctgcgcaagctgctgcctacgctgccccccgacaagaagctctccaagattgagattctgcgcctggccatctgctatatctcctacctgaaccacgtgctggacgtctgaactcagcctgtctcccacctcccgggcctctctggggcccctttccaccgctcactgcttagaaaggccgcatcctccccgagcccttataccttggcatggagtcccaaaggccctgggcacaggcagagagcccaccggctggtcatgagggcctcttcctttctctgacccaggcacctcgagggctattctcctgggttccttccggggtttattgctgaggcccagctgtgcagaattgtttgctagtgtggttggtatggaatccttgctggctttactaagccagccacacttggagtctgcccccaagctctctcactgaatgctgcctcttctacccctatgtccaaattttcagccaccacagacctcagctgtgtatcctatctgttctagcttctcctgcccctggtggggatgggctgtcagaattgcaagggaggaaggctggggttagagtggggagtgggcttcttcctccaagatctcagtctctcagtgcttggcagaggggtgaggccctggggaggcaggggttggtgccctgactcctgtgaggggaatctcagtagctgggaattatggaaaaactcttcctgtttctgtccatcttgttcctgtggcttagcacatacagacctcagatcttacttggtagtgagtgccttgccctctttgagctatttggctacttccctgtccctctgactcctactgtcccaattttctccctccctgtgtgtcactagagaaaaaaaaaaacaaaaacctagattccggattaggggatgacatcccaaacagcccggagtatttgcagaaggctcaggcaacgagtgggccacatctcacttctgcttcctcatctcagcccactctgaaaatgtgcagcaccctcactggttcctccccccaacgcaaggaggatgcccaattgttgccctctgaaaatgcacagttctcctggccctaggacttacttattacatttttttctctttccttgagctgcctttggcaagggaagagacccccaactctgcgcccctactccatgctgctgatccccacctgcgcactatagctcagggtcagcagtggaatgaagggccttagaacctgcatagaagaaatgaactcactgcatttctgtgctccctcctccctcgcaccaaactcctagctctacaagtatatttatttatttatttatttattcatctatttatttacttatttatttatttataaatattgctatttattgccgagttgtgcactttggggtagagtgaggggctcccagcagctctagctgggtctctcttgcttcctccctgcttacgcctttccttttcttgctccttcttcaactcctggtgtgtgtgagcatgccctttgcttgccacaccatatcctttccccagatccacctgtcctgacactctagtcctccaggatagtgctcctcccccagctccagggctcctggatgtccttcctcaactccctccacccctagacaatcctacctggtcccatctgcctcttttctctccccagcctgccctgtgacccttgcctcttcctgatactcccaagagcaggccccaggggtctgtgtcacatatctctgtgtgattccttctggttgcatccccaatttcatacaaaaagaaaaataaaagtgacctcgttctagcaccaggaaaaaaaaaaaaaaaaaaaaaaaaaaaaaaaaaaa

SEQ ID NO: 687 - DNA, 2512 bp, Homo sapiens
aattggtaccaggagagcccagaagccacacacgcatctctgcctctttgctctggctctcccaccctcttcccgtctttctctgcttccttgtcactgttactccaggagacgttcacttttcaccaacctttctccaagcatctccaagccactgactatatatattttgctacaagagacctagaagaggaaaaaaggcacgagacttttcaacacatcgtttaaaaaaatcatcaacgaatttcttgcaatgtttgagaacaattaaaaggaaaaagcgttttttaaaaaatctatcaactaagtgaacaatcattcatatcgtctacatcctgagatattattgtccctcgctgcggacaccagcgagatgacagctgctttttcatttttgaatgtaataaatatttgctgcttttaatattttccggaatctcccctcgctattccttggaattttaactctaaagattggagaacagattatcaaaaaggcttttgcaagcctccaaaatgatgctgagtccggaccaagcagcagattcggaccatcccagctcggcgcactcggatccggagtccctgggcggcacggacaccaaggtgctcggcagcgtgtcggacctggagccggtggaggaggccgagggcgacggcaagggcggcagccgagccgcgctctacccgcacccgcagcagctgagccgcgaggagaagcgccgccgccggcgcgccacggccaagtaccgctcggcccacgccacccgcgagcgcatccgcgtggaagccttcaacttggccttcgccgagctccgcaaattgctgcccacgctgcccccggacaagaagctctccaagatcgagatcctgcgcctggccatctgctacatctcctatctcaaccacgtcctggacgtgtagggcggggtgcgccgcggggggccgcctgtcccggcgtccgcgaaacgctacggatccggacgggcgccgtcgctcgggtggcggaggctgcggtggcccagcgagacggccgcctcgagagacggccggggaagaagctcgctacctgttctctctggtcagcagggcgacgagggaaggtttccgacgcaggcaggtggggttgtctggcgagcccgggggctcgcaggggggattttccaggccaggagaacctcgtggagacacccgagatgagccacttctggggctccccaagggttgtggttttaacccactggagactttgagttctcctacattcatccgccacaaatcttaatgtgttgaaagaatgagggcagaagttcagagtatgcaggctcataactttaggctatctggaatttttctaatggacaaatcaccaaacactgggaaggaggagagaggagggatctctcccatagagatggaaggcacagaaaggtgcgactggaaactttcctttctgttgtgaaaataaagattatattagaatccaaataaaccctgaatatttagtaagtttaaaaagacaaattgagaacaagtagacacactgtgggaggatctgagcttggtgatattttatccccaagatatgacaccaaggtagacaggaaaatccatatttaaatggaaactttaatatctgattacttttgcaggcgaagtgcccctttatatatccaaaaacatctatttgtgaccttaaacatgtggacccataggtgcagttagaaaaagacaacctatttttatttatgttagaaggagtagagtatttttttcaagacatttatttttcagagtggtgatacttttactttggatactctgtgccaatttatttatagtcaagtgtttacactttttcctgtggaataattatgtctaactttttacgtgtttgttgagattatactgtggtctttctttctgctctaattatattgcacttgtataacaaatttcccacttctccctgtttctaaacatattttatatattaagatgtttgttcttgaaaggttcttttgttgtgagatcagcaacactagcacttcactattatagttttttaaaaagtgtattattcttatctgtagttatgtctgagaagtcctttacaagctgtttataaggagagtagcttctttgtgtgtgtgatgtttgtgcgtgtgatgaatttagcaaattaagttattttcctaaaaaaaaaagaaaaaaagaattcagaactactttcctctgtgacaccaaaaagaaaagtctataacctgaaaatgtttcatgttctctgctgtgaaactcttaaaacaaggagtgtattttagagacaagggaaaaaaaccacatctgctatccaaagattttagtctttttcagggtttttttgtgtctctgttgctttatataatgcaatattttgtagtgaaaatagatataatctggtttctatctgacgagtttttcatatctcatgaatggtgcgctgttttgcatataaataaaggtatcaaataaa

SEQ ID NO: 688 - DNA, 2092 bp, Homo sapiens
gcggccgccggagcccgagctgacgccgccttggcacccctcctggagttagaaactaaggccggggcccgcggcgctcggcgcgcaggccgcccggcttcctgcgtccatttccgcgtgctttcaaagaagacagagagaggcactgggttgggcttcatttttttcctccccatccccagtttctttctctttttaaaaataataattatcccaataattaaagccaattcccccctcccctcccccagtccctccccccaactcccccctcccccgcccgccggggcaggggagcgccacgaattgaccaagtgaagctacaactttgcgacataaattttggggtctcgaaccatgtcgctgaccaacacaaagacggggttttcggtcaaggacatcttagacctgccggacaccaacgatgaggagggctctgtggccgaaggtccggaggaagagaacgaggggcccgagccagccaagagggccgggccgctggggcagggcgccctggacgcggtgcagagcctgcccctgaagaaccccttctacgacagcagcgacaacccgtacacgcgctggctggccagcaccgagggccttcagtactccctgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagccgccaccttccaggcgggcattcccttttctgcctacagcgcgcagtcgctgcagcacatgcagtacaacgcccagtacagctcggccagcaccccccagtacccgacagcacaccccctggtccaggcccagcagtggacttggtgagcgccgccccaacgagactcgcggccccaggcccaggccccaccccggcggcggtggcggcgaggaggcctcggtccttatggtggttattattattattataattattattatggagtcgagttgactctcggctccactagggaggcgccgggaggttgcctgcgtctccttggagtggcagattccacccacccagctctgcccatgcctctccttctgaaccttgggagagggctgaactctacgccgtgtttacagaatgtttgcgcagcttcgcttctttgcctctccccggggggaccaaaccgtcccagcgttaatgtcgtcacttgaaaacgagaaaaagaccgaccccccacccctgctttcgtgcattttgtaaaatatgtttgtgtgagtagcgatattgtcagccgtcttctaaagcaagtggagaacactttaaaaatacagagaatttcttcctttttttaaaaaaaaataagaaaatgctaaatatttatggccatgtaaacgttctgacaactggtggcagatttcgcttttcgttgtaaatatcggtggtgattgttgccaaaatgaccttcaggaccggcctgtttcccgtctgggtccaactcctttctttgtggcttgtttgggtttgttttttgttttgtttttgtttttgcgttttcccctgctttcttcctttctctttttattttattgtgcaaacatttctcaaatatggaaaagaaaaccctgtaggcagggagccctctgccctgtcctccgggccttcagccccgaacttggagctcagctattcggcgcggttccccaacagcgccgggcgcagaaagctttcgattttttaaataagaattttaataaaaatcctgtgtttaaaaaagaaaaaaagaaaaaa

SEQ ID NO: 689 - DNA, 2117 bp, Homo sapiens
agtccctgcagtggctgtaacaaaacccagacccccaggtcccggccaatggaggcgatttagactggagtgggaccgcgtctgtcaaaagcccgactcggcagcagcggcggagtccaggaggagagctggagccgccgcgctgcctccccgcccccgccgggatttattatttggactggacaattaagtggccctgatgatgttaccaagcccggtcacctccacccctttctcagtcaaagacattttgaatctggagcagcagcaccagcacttccatggtgcgcacttgcaggcggacttggagcaccacttccactctgcgccctgcatgctggccgccgctgaggggacgcaattttctgacggaggggaggaggacgaggaagacgagggcgagaaattgtcctatttgaactcactagccgcagcagacggccacggggattcagggctgtgtccccagggctatgtccacacggtcctgcgagactcgtgcagcgagcccaaggaacatgaagaggagcccgaggtcgtgagggaccggagccaaaaaagctgccagctgaagaagtctctagagacggccggagactgcaaggcggcggaggagagcgagaggccgaagccacgcagccgccggaagccccgggtcctcttctcgcaagcccaggtcttcgagctggaacgcaggttcaagcagcagcggtacctgtcggcacccgagcgcgagcacctcgccagcagcctgaagctcacatccactcaggtgaaaatctggttccagaatcgcaggtacaagtgcaagagacagcggcaggacaagtctctggagcttggcgcacacgcgcccccgccgccgccgcgccgcgtggctgtcccggtgctggtgcgggacggcaagccgtgcgtcacgcccagcgcgcaggcctacggcgcgccctacagcgtgggcgccagcgcctactcctacaacagcttccccgcctacggctatgggaactcggccgcggccgccgccgccgccgccgccgccgccgcagcagcggcggcctacagcagcagctatggctgtgcgtacccggcgggcggcggcggcggcggcggcgggacctccgcggcgaccactgccatgcagcccgcctgcagcgcggccggaggcggcccctttgtgaacgtgagcaacctaggaggcttcggcagcggcggcagcgcacagccgttgcaccagggtactgcagccggggccgcgtgcgctcagggcaccttgcagggcatccgggcctggtagggacggggcgggtcacgcggcgggcaccccagcgcagcctggcgccgcgggactgaagctcgagaagggcctgacctaaaggtcaggtcccctcgttaaaaaaatatgtacgtctagctcctcagggcttcggatcgcagctcactcgaggcctggggaaggggactcaggggcgaggaggatgactgggtccggtcgccaggactgtctctgaggcagaaacgccggctgggcgccggggaggacgatggccccgaccctggcagcgagaggagaccaggaggctaggaccctggccgcgcttggttcttccaaagcgagaagggcttctctccctctgcctttccgcggcctccgcgaagcgttggcggggagcccaaggacataacaaattaaaagcatgaaggagagaaaaatgggggtcgtggcttgagaaattccaggccctaccgatcctctgccccctttgcgggcctggagcgccatagcacagtcgatttcgtttcgcagctgtctcccctccgcagcagatacctcggtccagatctccggattgtcgggggacgcaggactcttcgaggaaaaccagccgaatgagatcaaaagttgggggtggggggaggctgaacaaactcaggacctggtggcccaccggaggtgttaccgggtttcctttctgtttcgtattctgtattcagcacatgttatctatctatctatctatataactataaccacacgccgtgtagacacccgctgccacacactacaggagtcaataaacaaggtgcaatattttcaaaaaaaaaaaaaaaaaaaaaaa

SEQ ID NO: 690 - DNA, 1291 bp, Homo sapiens
atgtcgttgagcccaaagcacacgacgcccttctccgtgtccgacatcctgagccccatcgaggagacctacaagaagttcagcggcgccatggacggcgcgccacccggcctgggggcgcccctgggggccgcggccgcctaccgcgcgccgccacctgggccctcctcgcaggcggcgaccgtggcgggcatgcagccttctcacgccatggcgggtcacaacgcggcggccgcggcggcggcggcagcagctgcggcggcggcggccgccacctaccacatgccggccggcgtctcgcagttcccgcacggcgccatgggcagctactgcaacggcggcctgggcaacatgggcgagctgcccgcctacacggacggcatgcggggcggcgcggccaccggctggtacggcgccaacccggacccacgctactcgtcaagtgagaggggccaggagcgcggggctgcgggcggctcaggcgtttcccgccacagccgaggggcgcgggggcgcgggacggggtgcgcgcggcttaggaggtcctggggccgagcgggcgcgcggggcgtcctgggacgcggcccgggacgcgcggggtttctggggaccctgggcgcgcggggggtcctgggacctgaccgggaacgcgcgcggcgtcctgggacccgttgagggcgtggtgctctgggacccgccgagggcgcgcggggcgtgctggggccggaggccgcggcggtcagggggtcttgggattcagcgagggcccggcggcgtcgcggccgcggcgtgaagagagcggcggctggaccggctcccggcgggcctggagctcactcgccttcccccttgggactcttccccagtctccaggttcatggggccgtcggcgggcgtgaatgtggccggcatggggtcgctgaccggcatcgcggacgccgccaagtcgctgggcccgctgcacgcggcggcggcggcagccgctccgcgaaggaagcgccgcgtgctcttctcgcaggcgcaggtctacgagctggagcggcgcttcaagcagcagaagtacctgtcggcgcccgagcgcgagcacctggccagcatgatccacctgacgcccacgcaggtcaagatctggttccagaaccaccggtacaagatgaaacggcaggccaaggacaaggcggcgcagcagctgcagcaggagggcggcctgggcccgccgccgcctccgccgccgtccccgcgccgcgcggcggtgcctgtgctggtcaaggacggcaagccgtgccagaac

SEQ ID NO: 691 - DNA, 1669 bp, Homo sapiens
gctcctgtcatcgaggcccctggcccaatggcaggctgagtccccctcctctggcctggtcccgcctctcctgccccttgtgctcagcgctacctgctgcccggacacatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgcaggatcgcggtgccagtgctggtgcgcgatggcaagccatgcctaggggactcggcgccctacgcgcctgcctacggcgtgggcctcaatccctacggttataacgcctaccccgcctatccgggttacggcggcgcggcctgcagccctggctacagctgcactgccgcttaccccgccgggccttccccagcgcagccggccactgccgccgccaacaacaacttcgtgaacttcggcgtcggggacttgaatgcggttcagagccccgggattccgcagagcaactcgggagtgtccacgctgcatggtatccgagcctggtagggaagggacccgcgtggcgcgaccctgaccgatcccacctcaacagctccctgactctcggggggagaaggggctcccaacatgaccctgagtcccctggattttgcattcactcctgcggagacctaggaactttttctgtcccacgcgcgtttgttcttgcgcacgggagagtttgtggcggcgattatgcagcgtgcaatgagtgatcctgcagcctggtgtcttagctgtccccccaggagtgccctccgagagtccatgggcacccccggttggaactgggactgagctcgggcacgcagggcctgagatctggccgcccattccgcgagccagggccgggcgcccgggcctttgctatctcgccgtcgcccgcccacgcacccacccgtatttatgtttttacctattgctgtaagaaatgacgatccccttcccattaaagagagtgcgttgaccccg

SEQ ID NO: 692 - DNA, 1857 bp, Homo sapiens
ccggacctcggctttcaaagcggcctgggtgggaagagctgtttatataaacagagattccgctgtaaatgcgctaatatcccggctgccagcgcatggcgagcgcctcccacgcccatccgtaggagcggcgtcccggccgcccctccgttcccagcctgccctgcccccgcctccttcccctcctcggccatggccacctctggacgcctgagcttcaccgtgcgcagccttctagatttacccgagcaggacgcgcaacacctgccgaggcgggagccagaaccacgcgccccccagcccgacccctgcgccgcctggctggattcggagcgcggccactacccttcctcggacgagagcagcctggagaccagcccgccagactcgtcgcagcggccgtccgctaggcccgcgtctccgggctcggacgccgagaaaaggaagaagcggcgggtgctattctccaaggcgcagacgctggagttggagcggcgcttccggcagcagcggtacctgtctgcgcccgagcgcgagcagctggcgagcctgcttcgcctcacgcccacgcaggtcaagatctggttccagaatcatcgctacaagctgaagcgcgctcgcgctccaggggcggcggagtcgcctgacctggcagcatccgccgagctgcacgccgcgcccggcctgctgcgtcgcgtggtggtgccggtgcttgttcgcgacgggcagccgtgcggcggcggcggcggtggcgaggtgggaaccgccgcggcccaggagaagtgcggcgcccctccagccgccgcctgccctctgccgggctaccctgccttcggtcccggctcggcgcttggcctcttccccgcctaccagcacttagcatcccccgccctggtctcctggaactggtgaggccgcagggcggcacctggggctaccctcgactttggagcgcgctctgcgattggagcagggccggagccgaacgcctggaacgctctccgtccgcctccctgcagccccatctccttgggcgccagggtccctggcgcgccctcatcagccgtcgcgcaagcacacacgagggacgtgtgccagagccccctccctcaccttccctccaccgccagccccagagttagattttatgcttgggccttatttgtatatttttaaatagcgatttgtataggaagcaagttatttttttaaaaaatagagtatttttcctcgtagttcgagaataaaatgtgtggggttgggtcccctgcgcgcctgcggggaacgtaggcgggagtcgtgccccccagaccggtgttcgcatcgctggctcgccccttgactggctaagtggggcccggccccagctggatcgaagggcgggttgcagtcccgacacggctttaggaagatacctgggggatggaggggtggtgatgtcagggttgggcgcgggaagaaaaggagaggaggaagctgaggcaactttgggattcttgtcagcgggaggcgtcactggccccagagtgactccgactctccgctgggctcccagagctgctggcgtttcgaataccgaaaagtcaaccctgtggaccacgacagggcagaaggagtttctccggagatgagccggcgaggccaggtgcggggcgcgctgcaccggagcagcccaggccgggccgcaagctgtttccagagtgcaggagccaagtgctcggggaccctttgaaaagtgcctggggacctgaagagcaccggggaatttgtaacccctatttaagcctgcaagtgcctaagttaaaaaaaaaaaaaaaaaaaaaaaaaaaaaaaaaaaaaaaaaaaaaaaaaaaaaaa

SEQ ID NO: 693 - DNA, 3281 bp, Homo sapiens
gcggtgcgggccgggcgggtgcattcaggccaaggcggggccgccgggatgctcagggttccggagccgcggcccggggaggcgaaagcggagggggccgcgccgccgaccccgtccaagccgctcacgtccttcctcatccaggacatcctgcgggacggcgcgcagcggcaaggcggccgcacgagcagccagagacagcgcgacccggagccggagccagagccagagccagagggaggacgcagccgcgccggggcgcagaacgaccagctgagcaccgggccccgcgccgcgccggaggaggccgagacgctggcagagaccgagccagaaaggcacttggggtcttatctgttggactctgaaaacacttcaggcgcccttccaaggcttccccaaacccctaagcagccgcagaagcgctcccgagctgccttctcccacactcaggtgatcgagttggagaggaagttcagccatcagaagtacctgtcggcccctgaacgggcccacctggccaagaacctcaagctcacggagacccaagtgaagatatggttccagaacagacgctataagactaagcgaaagcagctctcctcggagctgggagacttggagaagcactcctctttgccggccctgaaagaggaggccttctcccgggcctccctggtctccgtgtataacagctatccttactacccatacctgtactgcgtgggcagctggagcccagctttttggtaatgccagctcaggtgacaaccattatgatcaaaaactgccttccccagggtgtctctatgaaaagcacaaggggccaaggtcagggagcaagaggtgtgcacaccaaagctattggagatttgcgtggaaatctcagattcttcactggtgagacaatgaaacaacagagacagtgaaagttttaatacctaagtcattcctccagtgcatactgtaggtcattttttttgcttctggctacctgtttgaaggggagagagggaaaatcaagtggtattttccagcactttgtatgattttggatgagttgtacacccaaggattctgttctgcaactccatcctcctgtgtcactgaatatcaactctgaaagagcaaacctaacaggagaaaggacaaccaggatgaggatgtcaccaactgaattaaacttaagtccagaagcctcctgttggccttggaatatggccaaggctctctctgtccctgtaaaagagaggggcaaatagagagtctccaagagaacgccctcatgctcagcacatatttgcatgggagggggagatgggtgggaggagatgaaaatatcagcttttcttattcctttttattccttttaaaatggtatgccaacttaagtatttacagggtggcccaaatagaacaagatgcactcgctgtgattttaagacaagctgtataaacagaactccactgcaagagggggggccgggccaggagaatctccgcttgtccaagacaggggcctaaggagggtctccacactgctgctaggggctgttgcatttttttattagtagaaagtggaaaggcctcttctcaacttttttcccttgggctggagaatttagaatcagaagtttcctggagttttcaggctatcatatatactgtatcctgaaaggcaacataattcttccttccctccttttaaaattttgtgttcctttttgcagcaattactcactaaagggcttcattttagtccagatttttagtctggctgcacctaacttatgcctcgcttatttagcccgagatctggtctttttttttttttttttttttttttttccgtctccccaaagctttatctgtcttgactttttaaaaaagtttgggggcagattctgaattggctaaaagacatgcatttttaaaactagcaactcttatttctttcctttaaaaatacatagcattaaatcccaaatcctatttaaagacctgacagcttgagaaggtcactactgcatttataggaccttctggtggttctgctgttacgtttgaagtctgacaatccttgagaatctttgcatgcagaggaggtaagaggtattggattttcacagaggaagaacacagcgcagaatgaagggccaggcttactgagctgtccagtggagggctcatgggtgggacatggaaaagaaggcagcctaggccctggggagcccagtccactgagcaagcaagggactgagtgagccttttgcaggaaaaggctaagaaaaaggaaaaccattctaaaacacaacaagaaactgtccaaatgctttgggaactgtgtttattgcctataatgggtccccaaaatgggtaacctagacttcagagagaatgagcagagagcaaaggagaaatctggctgtccttccattttcattctgttatctcaggtgagctggtagaggggagacattagaaaaaaatgaaacaacaaaacaattactaatgaggtacgctgaggcctgggagtctcttgactccactacttaattccgtttagtgagaaacctttcaattttcttttattagaagggccagcttactgttggtggcaaaattgccaacataagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaaggattacacatttcactgtgatgtatattgtgttgcaaaaaaaaaaaaaaagtgtctttgtttaaaattacttggtttgtgaatccatcttgctttttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagtacccatgtctttattagattta

SEQ ID NO: 694 - DNA, 1116 bp, Homo sapiens
cgtgggatgttagcggtgggggcaatggagggcacccggcagagcgcattcctgctcagcagccctcccctggccgccctgcacagcatggccgagatgaagaccccgctgtaccctgccgcgtatcccccgctgcctgccggccccccctcctcctcgtcctcgtcgtcgtcctcctcgtcgccctccccgcctctgggcacccacaacccaggcggcctgaagcccccggccacgggggggctctcatccctcggcagccccccgcagcagctctcggccgccaccccacacggcatcaacgatatcctgagccggccctccatgcccgtggcctcgggggccgccctgccctccgcctcgccctccggttcctcctcctcctcttcctcgtccgcctctgcctcctccgcctctgccgccgccgcggctgctgccgcggccgcagccgccgcctcatccccggcggggctgctggccggactgccacgctttagcagcctgagcccgccgccgccgccgcccgggctctacttcagccccagcgccgcggccgtggccgccgtgggccggtaccccaagccgctggctgagctgcctggccggacgcccatcttctggcccggagtgatgcagagcccgccctggagggacgcacgcctggcctgtacccctcatcaaggatccattttgttggacaaagacgggaagagaaaacacacgagacccactttttccggacagcagatcttcgccctggagaagactttcgaacaaacaaaatacttggcggggcccgagagggctcgtttggcctattcgttggggatgacagagagtcaggtcaaggtctggttccagaaccgccggaccaagtggaggaagaagcacgctgccgagatggccacggccaagaagaagcaggactcggagacagagcgcctcaagggggcctcggagaacgaggaagaggacgacgactacaataagcctctggatcccaactcggacgacgagaaaatcacgcagctgttgaagaagcacaagtccagcagcggcggcggcggcggcctcctactgcacgcgtccgagccggagagctcatcctgaacgccg

SEQ ID NO: 695 - DNA, 1019 bp, Homo sapiens
gccgcgcgcaaacttcccgggccggcgggcaggggcggcggcggcggggcccggatgggagcccgggccggcggcggcggcgcccatggacactaaccgcccgggcgcgttcgtgctgagcagtgccccgctggccgcgctgcacaacatggccgagatgaagacgtcgctgttcccctacgcgctgcagggtccggccggcttcaaggcgcccgcgctggggggcctgggcgcgcagctcccgctcgggaccccgcacggcatcagcgacatcctgggccggcccgtgggcgcggcgggcgggggcctcctgggggggctgccccggctcaacgggctcgcgtcgtccgccggcgtttacttcgggcccgcggccgctgtggcgcgcggctaccccaagcccctggccgagctgccggggcgcccgcccatcttctggcccggcgtggtgcagggcgcgccctggagggacccgcgtctggctggcccggccccggccggcggcgtcctggacaaggacgggaagaagaagcactcgcgcccgaccttctcgggccagcagatcttcgcgctggagaaaaccttcgagcagaccaagtacctggcgggcccggagcgcgcgcgtctcgcctactcgctgggcatgaccgagagccaggtgaaggtctggttccagaaccgccggaccaagtggcgcaagcggcacgcggcggagatggcgtcggccaagaagaagcaggactcggacgccgagaagctgaaggtgggcggctcggacgcggaggacgacgacgaatacaaccggcccctggaccccaactcggacgacgagaagatcacgcggctgctcaagaagcacaaaccctcgaacttggcgctggtcagcccgtgcggcggcggcgcgggggacgccttgtgaggacccgcggggtgggggcgaatctatttttgcagaatccgggggcggccccgggtgggcgcgagtcgctttgtatcatcaataaattatttaacgggtc

SEQ ID NO: 696 - DNA, 1501 bp, Homo sapiens
ctgttagtgactaatcattggagacaaccatgtttagtatttgagcattggttaaatgctaaagaaaaatcgccgttaaagcagttttctttttcactgtctttttcttttcgcggggaacccagctgttcctgcgagggccacctcctcaggaagaccccgcagctctcccgcggcgcttctgcaggaggcagcgacagtttcgagaacccgggccttcccctcccagtgcctcccggggttccggcgtttcaggcgctgctgttttccgggaagggcaggcgcgctgggccttggggagctgcgctcggcgggcggacgcgggggatcatggaagctgataaagatgacacacaacaaattcttaaggagcattcgccagatgaatttataaaagatgaacaaaataagggactaattgatgaaattacaaagaaaaatattcaactaaagaaggagatccaaaagcttgaaacggagttacaagaggctaccaaagaattccagattaaagaggatattcctgaaacaaagatgaaattcttatcagttgaaactcctgagaatgacagccagttgtcaaatatctcctgttcgtttcaagtgagctcgaaagttccttatgagatacaaaaaggacaagcacttatcacctttgaaaaagaagaagttgctcaaaatgtggtaagcatgagtaaacatcatgtacagataaaagatgtaaatctggaggttacggccaagccagttccattaaattcaggagtcagattccaggtttatgtagaagtttctaaaatgaaaatcaatgttactgaaattcctgacacattgcgtgaagatcaaatgagagacaaactagagctgagcttttcaaagtcccgaaatggaggcggagaggtggaccgcgtggactatgacagacagtccgggagtgcagtcatcacgtttgtggagattggagtggctgacaagattttgaaaaagaaagaataccctctttatataaatcaaacctgccatagagttactgtttctccatacacagaaatacacttgaaaaagtatcagatattttcaggaacatctaagaggacagtgcttctgacaggaatggaaggcattcaaatggatgaagaaattgtggaggatttaattaacattcactttcaacgggcaaagaatggaggtggagaagtagatgtggtcaagtgttctctaggtcaacctcacatagcatactttgaagaatagacttaacagaatcatgaaaactatagctttttaacccggattactgtaaatgtttgacaaaaatgaatatgcttttccttaaaaaatgaaaactttaatttttaccatccatttatgtttagatacaaaacttatttccatgtttctgaatcttctttgtttcaaatggtgctgcatgttttcaactacaataagtgcactgtaataaaaagttttgtttatagaaaaaaaaaaaaaaaaaaaaaaa

SEQ ID NO: 697 - DNA, 2066 bp, Homo sapiens
tcatccaggcccccccccccccagctccttgctgggaccctgagccctgcacggatctcagtttccctagaaggtctcccgagggcactaagcgttgcccctggccccctcccgctgcaggagactcggggctcggagcccgcctgagcgagccccccggagatggcggccccctatcccggcagtggcggcggaagcgaggtcaaatgcgtgggaggccgcggcgccagcgtcccctgggactttctacccgggctgatggtcaaggcgccgtccggaccgtgcctgcaggcgcagcgcaaggagaagtcccggaacgcggcgcgctcgcggcgcgggaaggagaacctggagttcttcgagctggccaagcttctcccgctgcccggcgccatctccagccagctggacaaggcttccatcgtgcgcctcagcgtcacctacctccgcctgcgccggttcgccgcgctgggggcgccgccctgggggctgagagccgcggggccgccagctggcctcgccccaggccgccgcggccccgcagcgctggtctccgaagtcttcgagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgaggccagcctcaccaaggtgcccccctcctccctggtccaggagcgctccttctttgtccgcatgaaatccacgctcaccaagagggggctgcacgtcaaggcctcagggtacaaggtcatccacgtgactgggcgccttcgggcccacgccctgggccttgtggccctcgggcacacgttgcccccggcccccctggctgagctgccactccatggacacatgatcgtcttccgtctcagcctgggtctcaccatccttgcttgtgagagcagagtcagcgaccacatggacctggggccctcagagctggtgggccgcagctgctaccagtttgtccacggacaggacgccacgaggatccgccagagccacgtggacttgctggacaagggtcaggtgatgactggttactaccgttggctgcagcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggaggcatccagcccggggccagagcccacagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgcaaaaaaaaaaaaaaaaaaaaaaaa

SEQ ID NO: 698 - DNA, 5268 bp, Homo sapiens
gtcacatggtcgcggctgccctccccgtcagccgccctcgccgccgcggtgcgctggctgcaggaagccgccgcgccgccgcttttgttgtcagggacccagcgaggagcgccgctcgccggccgccgccaccctctctcgctgcagcctgctgtgcgctgcacggcctggggcccgggagccccgcccgctctgcccatgagggggccccgcgaccaccgctgcttccagcccggggcggcgcggcgctgaggcggcggcggcggcgctgccccctctgcgggaagcgggcggccccggccgcctccgcgagggcaccatggaggtgaatgcaggaggtgtgattgcctatatcagttcttccagctcagcctcaagccctgcctcttgtcacagtgagggttctgagaatagtttccagtcctcctcctcttctgttccatcttctccaaatagctctaattctgataccaatggtaatcccaagaatggtgatctcgccaatattgaaggcatcttgaagaatgatcgaatagattgttctatgaaaacaagcaaatcgagtgcacctgggatgacaaaaagtcatagtggtgtgacaaaatttagtggcatggttctactgtgtaaagtctgtggggatgtggcgtcaggattccactatggagttcatgcttgcgaaggctgtaagggtttctttcggagaagtattcaacaaaacatccagtacaagaagtgcctgaagaatgaaaactgttctataatgagaatgaataggaacagatgtcagcaatgtcgcttcaaaaagtgtctgtctgttggaatgtcaagagatgctgttcggtttggtcgtattcctaagcgtgaaaaacagaggatgctaattgaaatgcaaagtgcaatgaagaccatgatgaacagccagttcagtggtcacttgcaaaatgacacattagtagaacatcatgaacagacagccttgccagcccaggaacagctgcgacccaagccccaactggagcaagaaaacatcaaaagctcttctcctccatcttctgattttgcaaaggaagaagtgattggcatggtgaccagagctcacaaggatacctttatgtataatcaagagcagcaagaaaactcagctgagagcatgcagccccagagaggagaacggattcccaagaacatggagcaatataatttaaatcatgatcattgcggcaatgggcttagcagccattttccctgtagtgagagccagcagcatctcaatggacagttcaaagggaggaatataatgcattacccaaatggtcatgccatttgtattgcaaatggacattgtatgaacttctccaatgcttatactcaaagagtatgtgatagagttccgatagatggattttctcagaatgagaacaagaatagttacctgtgcaacactggaggaagaatgcatctggtttgtccaatgagtaagtctccatatgtggatcctcataaatcaggacatgaaatctgggaagaattttcgatgagcttcactccagcagtgaaagaagtggtggaatttgcaaagcgtattcctgggttcagagatctctctcagcatgaccaggtcaaccttttaaaggctgggacttttgaggttttaatggtacggttcgcatcattatttgatgcaaaggaacgtactgtcacctttttaagtggaaagaaatatagtgtggatgatttacactcaatgggagcaggggatctgctaaactctatgtttgaatttagtgagaagctaaatgccctccaacttagtgatgaagagatgagtttgtttacagctgttgtcctggtatctgcagatcgatctggaatagaaaacgtcaactctgtggaggctttgcaggaaactctcattcgtgcactaaggaccttaataatgaaaaaccatccaaatgaggcctctatttttacaaaactgcttctaaagttgccagatcttcgatctttaaacaacatgcactctgaggagctcttggcctttaaagttcacccttaaggcctttgtttatttaaacatgaactgatggtaactgtacattttgtgctaaaatgcatatttatatgtgtataccatatgtggagatagaaaagacctttaagacaataaaagattgtaggctatctctgtaatcatgcaatagctgttcggattgagaactcttcagccatgattagacgttgactgcatctccctgatagaccaatcagctgtgtcgcacttaaactggagaagttacactgaagtataatcacactgaatgttagactttttcatctgccaaaaccaaaaaccattttgatctccctgtggttatcaatataacgcacaatcacaagtgtatgaggacttagaaattaatcctttgtggtaggagttctgttgaatgatggaaatcttattactaccacaagactatttgatctggtaattggagacttcgggatttaggagatctccatgtctgtatttactctaccactgctaaagtgtgtggtcctgggtagtttacttgcttgcggaaaatgagaattgatggtgtccccaatgccccacctcacagagttactaaaaaatgtctgtaaagcatatttacctcttgggagataggcactatgtaaataaggtaaaatttctgttattacaattattcataataatattcttttcttatttctaagcctttctgggaaatcatttcagtccacaccaaccatattattcagggttcctgccatatgtgtggggtatcctactgatacacacgtattcaaagtttatgggtacaacaaagacatagtacatgtacataatatgtatgtgaatatagttaaatatatttcttcacaatattttaaactgtgaagaactttatcatacaggaaacttaaaacaagaggtgtcaaaagacccaaattaggtgcattttacttgtttatgatggcataaccattgctttaaaatgtttagacagtagaatattgaatttatgctctatttttgtttatttaagcaacacttaatgtaaaagtgcaacaggcaattgaatccaaatttcaacgacaaaaaaaaaaaacatgtattttagagttcatctttggcaaaatctttggttcagggtactagttgtttaaaagttgattcatattcttaccttgtgctgagaaaggttgcattgctgccccttatacacatgctgcagcttgatgttaaagaatttttattctttctgaagaactaattaatgtttaaagcaactgtttaatatgatggcatgtgtgtgtgtgcgtgcgtgtgtatgttctgagtccacttcttttttcctaaataacactacagggattttgtcatattagatttaatttataatttgaaaaatcatctagtgtgtgacctacaggcttagaaatggtatagtcaaagacattttatccacatttctaatagtggacttgattaagtagataagatcagcatctgtttatggtagtaggagaaatagccaaagttgaggattttatgtatgttttcctgtttacctggaaaatagcaattaattggattttttggtaaagattgccttctgtataatgtttggattatataaaattgcaaaaatgataacagcccgctttactgtactaagcctgttactttcatgacgtgtgagcagaatgccttattttgtaatcttgtttaacttgttgctactgggacttgatttactgtggcactagttaagtaagttaaaaaaaagttaaaccctctcattattaaagaggaaaggcgatggtgatgtctgtagtacaatataaaccataattgtgatttaccttaagtaggtataactcttatgggatatacagtatagtttttgtgaatctttacatgatagcattatctttttataattttttttcctaagataaacaaatgcatagttttcttctatgggtgatagaaacagctttttgaagtaatgaaaacctcaaaagatcatgttgattcttaatttttgccttttgcataagcctctttataacatgtatctttaaaacaattaagtctttaggaatgtgtaaccagaactatgttagtattgcttataaaactttagttaggttcaatatatacatatatacatctctatataggtatatagatttgcattttgtcttgtaaaattttatttgaataaattcttcctgtaggtaatgggaaacaaaattaatagttcatatgtcactcatagcatttctatatttgaaagtagcccaatataaaacttttgattctaaaattaaaccagcagcctattacaagcacattctttgattgagtcattggttataaacttactaaatgcagagaaagcagccaatttaggaaacttctgagttggtgggacactgttgattaataatgtactgtatgaattaagtgatgctttaactttgattttacattttaaagttaaaatgtgggcattatgtcagcaaacttaagggcattatgtcagcaagctaaaacattttttttcctgtgcttttaatgtatctctttacatgatctgagagaggattcaagttgatagaaatagctgaggggaaaagggggaacatcttgggatgaagcttgtccttatggtgatggtttaattacagattaaaaaattagaaggaaatttcagtggattaagtgtatagctttcatatctacatttcaagaaattaccattgtaacttgataagagatgatttattttatgtaaacatctttgcaaagcaaggtgtagcagctcagctagatttattactgtgcacgaaagtaaatacctatctcaattattctttttcttttccaatataaagtttgctgaatgtacaagaagagtttatcacttaggatatagaatttttttaggggttgggggaggggatctgttaggaaactgttacctataaacaaagattgactggattcgatccaaaagataaaacttgaagctattctggaactaacatggaaaaatgaaatggctattgtttaaaaaaatgatagaaatacattgttgatgggatatgagttaagtttattttctacaaactgtaattgatgaggacatggataatatcttcatgtttctgagaagtaatctgtatgtggggggaggggataataaatatttctaaccaacaaaaaaaaaa

SEQ ID NO: 699 - DNA, 2087 bp, Homo sapiens
aagtttcacgctccgcccctcttccggacgtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccagggccttcctcttcctctgcttttatttaataaaaactaaaaacagaaacaggaaaataaaatatgaatacaatccaaaaaaaaaaaaaaaaaa

SEQ ID NO: 700 - DNA, 1720 bp, Homo sapiens
agtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggttgcgaa

SEQ ID NO: 701 - DNA, 2213 bp, Homo sapiens
actctctcctcctcctcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaatattgggctagatagaacaactttctctacattgtgttttaaaaggctccagggaatcctgcattctaattggcaagccctgtttgcctaattaaattgattgttacttcaattctatctgttgaactagggaaaatctcattttgctcatcttaccatattgcatatattttattaaagagttgtattcaatcttggcaataaagcaaacataatggcaacagaaaaaaaaaaaaaaaaaaaaaaaaaaaaaaaaaaaaaaaaaaaaaaaaaaaaaaaaaaaaaaaaaaaaaa

SEQ ID NO: 702 - DNA, 4446 bp, Homo sapiens
ttcttaaccctttccagctttcccaccctctttggctttagccatggccttctgatctgtgtttctcaggggacctgcaggccccagatatagccccatgctgtcctcctaccccagagcacactgttcaggctacttccactggtactgaaatccagtatttcacttactctttttctttccaatatcctcatgacattcaatatttcacttactctaggtcctccctgcctaaggcccaagtcaactttctgtccagtgggatttgtaatccaatacctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcactcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccggctgccaggggtgcttagcagtggctgcgagttgccagagtctctgcaggccccatcgagggaagaagctgccaagtggagccaggtccggaaagatctgtgctctttgaaggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaacgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggatgggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggcgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacaatttggatcaaaaggagaaatgataagtgacaaaagcagcacaaggaatttccctgtgtggatgctgagctgtgatggcgggcactgggtacccaagtgaaggttcccgaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggctaaaaaaaaaaaaaaaaaaaaaaaaaaaaaa

SEQ ID NO: 703 - DNA, 1381 bp, Homo sapiens
ataaaacagacatctcttgttttccagatactacgggtcataatccctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggttgcaatgaaagactaaagcaataa

SEQ ID NO: 704 - DNA, 4029 bp, Homo sapiens
gcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagataaaatgtcaacagaaagaagaaaattattgatggagcacatcttcaaactacaggagttttgtaacagcatggttaaactctgcattgatggatacgaatatgcctacctgaaggcaatagtactcttcagtccagatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaattgtgttctagtcatatttaacttcattatgaactagtaaaaatacttaatggtcagaaatccctaaggagttagttccttgcattttactctgccataataatttttgtttaattaccatatcaaaataagattattttatgcttactggtataatgacagtattagaactataggaaataattgaatacatattttttgtcttctctaaatatcatggtgtcccttagcatatactactctcattgctggcagtgagacaggccattcatgatcttaagagttgccatttttaatgtatattattagttacaagcactttatatagcagaaaattgtttttgagaataagctagtgttgatattttaatatttttagcttactgctcgtgtttttgtttttgttttcgtttatagaggtgggtttcactgttgcccaggctggtctcaaactcctgggctcaagtgatcctgcctcagcctcccaaagtactgggattacaggcgcgtgccaccgtgcctggcctactgctgtctttgaaaataatagagactagccaggtgtagtggctcatgcctataatcccagcactttgggaggctgaggcaggcagattgcttgagctcaggagttcgagaccagcctgggcaatatagcaagacctcgtctctgtaaaaagaaagaaagtaataaagactaattgagcccaaaatgtttcactatttcaaaaaagatatttaaattgttgctctttcattccataaaaaggatctgatctctctcccacttttctgacctgagttagagcttcccaaacctgtcatgtatgggttttagccaatttcttttagatcactaaaaaaactcacccaatatgtcaaataatggatttatcatagccagtacatgttctcaaggcaagtttaaacattattttgaagctattgataattttttaaaataaagaaatattcactgatttttttcactgtaaagcacgggagggctgctttaacaacagtataagaatcagcctgaagccttgttactgctacaacaaattcattttagactcctcggatgtcttccacagtaatttattcttttagcaaacctgatactgataactgtttctttgctttgatttcttgatgaattattttggtatgtttgttgatttttaaagcaaacacggataatgcactcagagtacattttttgtaaagatttttgcaatagaagaaaagtgaagtttttgtggggatgtggattttattgcttactactttatagtaatcaaaagtttgaaaatatcaacttacagtctttaccagtttactaagggaaacttttttccctatttaaaacatgatcttagtcaacaattttatttataattatcagctaaattacatttagtataatactcaaatggaaaaatcagtagtttatacctttataaatacagtttagtaagccaaggaatcagggaaataatcctttaaaataatgtactaatagttaagatgtttcaggtgttttttctgattaaatttgctactatatttggaagactttaaaactatattaaaatgtgacttgcattacaaaaaaaaaaaaaaaa

SEQ ID NO: 705 - DNA, 8330 bp, Homo sapiens
ccgctcccacctcggcgtctcgtctctcgcccgctgccccgcgagcccgcggcccccgggctcccgccatccgccgacaccgggagcccgggctccccgcgccctgccctccgcgccgggggccgcccgccgcagacacgggacccgcttcgaggccgctttggcgccaaatcctgaggtaacacgtacacagacctctcggccggaatctccagggatgaccagcccctccccacgcatccagataatctccaccgactctgctgtagcctcacctcagcgcattcagggctctgaacctgcctctggcccattgagtgttttcacatctttgaacaaagagaagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaatagtatgtgtgtatatatatatataaaaaagtccttggaattatagatactaattaccagggtaataatattagcactttctaagcacttatcaatgtgtaacgttagcaacatcttgcctgtgggcagggcaaatggaaaactgtgtatgtcttttgccgaaatgctaatgatttctgtgaaaactcactagggtacaggagacaatcatttatgtttaagaaaagaaggcatcattcctaattgtgtgcacatgttgtggagttgagctgaattctgtgaatggaaacgtggctcatttgcatcatgcagtaagtgggagtgtggtagcacagtcggtggtgacccagttcagaagcttctagccatagagcagacacttgtcaggttccctgactacttggtcctggtctctgatgggcatctgcagactcctctagaacctggggttctcctttgatgactggttatctgaattggattgcaactagtcagacattaactgccaaatgagatgtacagttcctccagcaagtgaaaacatccccaagtcacatccgccgctcgtggcagatggagccttgtgaccaaaaagtgcaaggtgggcattttgagctcttgacagtacttccaatacaattgggggtgcttgtgtgtttgtccagatggaggagtgtggccttggagtgtgagcgttaccttcccagggctttccactccaaatgcccccttgaaaagggctcgtgtttctgcagctccatcataactgtgaggctggattggggctgggcaggagcctgctgccgcctggcgagagtggttagggcctggtaaagctggatggaaggtttcaggacaatttcttcctgttgaccttaaataccagagattttaaaaatgtgtatagactcagcatctctgttggcaagtctgttaatgttaccagcacactgtgcactttggttcccccaggtgtgtgccagccgaccaccccggagcattttaaatgcaggctgcttgctccttaaaaacaaccctcaatttccagggtgatagtctttctcctcataaattgtagcaaccagagtttacagcaagaacagtatgcgcttaaaaggaagttatgtctaacttcaaacacccgtaaattcccacggatgtgaatatatagcaagcttttcctgtttgagaacagtggcatgtggaagacccggtcaattgctttgtcttttgctttttaaatagtccagattaagaaaatacaccctgttgggttaaatttgcctctcttgatttgttaatcagatgatatccaaaaagatccctggacactcccctgactcacaggtgctctgatctggctcaggctggcgccacatgtgctccacaggggtgcagtctggccagctacagacgcccctgtggtgccacattggacagaatggaagctgctgcaggctcaaggcagaacaggatgcttgatcctgaagggttagcagcactttacgcaagtcagtgttagtagggtaagtgggaacagtgtttccaacttctaaattcttgtttggatttaattatatcattttataattcttgccttggcagcaaattttggagagtagtgggagtggccattataaaatgatggaaaggatttaattttgccagcttaaagtaatttttacttttctaaccctgatgtgttttcagtttcaaaattaagacaaaaaaccagctgagacaatggaattagggcaggtttgtttcatttctgcttgtgaaggcttttagtagcaggcatcctgcagctcagtggtgcctctaacacagattgttgcctgccttccgtcgttttgatccttgagagtgaccatgagggccatgttgcagttccctgggaatacaagcataacagctttcagatcccagttcttggtgttggtgaaaaggtctccaccagcccctcctctcattcccaggtcattcagtggcagccagtaggctgcttagactcaggctggataaggaagtgttgggctgtggtgaaacaaccttgcagaaaacgtgattttgcttggaaaggtgctgattctaacctggtcctgctctttaagtccccttgctggtgatggctgattccagggactgttttgggctttgaacacctcttggttggtttctgagatcctcttggccttactttgaagtggccttttctttaaggatcatgtccacgtaacctgtattcttgctgctttaactcatttcaagcctctgactgcaggtccatttcatctcctgtcaggttggttaagtaaagtcagcccaaagtcaagaattacttaaagagatgcaaaccaaatatttgggctccaactttcacagggcttatagcccttattagcagtttgtgaaactttgggtttcatgaagtgagacctgtcctctggctactgaactccatggagccacgttcatgctccctcttctactggcctggctgctcctccctcaatgaggagaggcagctggctcagagaggtgggacagacacatgctgtcatcagttaagtgagctcttttccagaagtatctcagataatgttgggttaagacagatagatgttgaaaatggtggagatcattacacattagcataaaacaggacaggaagagattttttgaaagaccaaattagttgagcaagtaatacttttcaagttactcctggaaggtgtttttaaggaagtgtgttacctaccatactctcctaatttgacatttctgtgtcctgaggagttacatttattgtctaacccttgccataaggctgtggtttgaggttcttttgctgttctgggctttatatttaatttcaggtgtagtcacttctaagatgtgtaattgccctcaagagggactgatttttagcttgtcattgtcagtattgaatgtggactcttctgaggcagttaggacaccagccatggtgttaacagtggatgcgttaggctccttaatctcaaggcaatatccacgctacacacatacttattagctgtcttacttgtttgggggatagttacggcaaggagcaaaaaattctaaggactctagctgtttctagtgcttttactttcatagtcctttgaggacatttcctgcagagcactcttgctcacagcccgccctctgcagggcttccagcccctggccgcaatcagcagttcatgccacatgtgtacatccatgttctgggacctgatctcattggagtccagaagcttgttgcccactttccagtgtaaatgactttatgtgcaatggggtcataggtaacattttaactcttttcttagtccaggtcataggaagtctcatcatctgacagccacttttctcccagggaaggcggtgcccactgggccctgggaatgcctgagccagcagagcagatgccccacgtgcttcctttatccagcttccattctctcagttatgaggctctttgaaaatgtcttaactttgatgtaaatttttaaagccaacccctcatcaagacagggttggtttgggtcttttgtacacagggtctggaccttctcattgtgtgcctcccaccagcgtgcacttcgtatgtccagccctgggtcccttcagcagcattgtgcgtgtacaggtttctaggctgtaagactgaatgaatgtacatgtgtttatatcctctccatatgtacagtgtatatagtgtgtgtatgtgtacatagatgtatattatgtatacagacatgtatccaaactttcctttaaagagagtttttcataaagttgctaatgtaaactgatatgggtgttccaaggtccctcggcagggaagatttgctggtgattttcttcactccattttcctttgggtgagcctgcctgggaagggccatgaagtcagaatctccactctgcaaaaggaagaattccaggcagaagaggttctgacagggtgacatttccgtatattctctaggttcggacaagagccaggaagctggaagacagtttatcttaatatccaaaactaagtgggaatttttaaccttttcatgcacctattcatggccctacctggaaggaacttggcagttgggttgagccatcagccttcccagctattcagctctgttgagtagcccagagacaggcgtcacggtcagagattcagaacggtctgtgtcagtgaggcctgactcccaaagatggtagcaatttcccaggcttgcgctgtgctcagtcagcaagatgtggggcactgtcctatgactgaataaatagtaattcccatctttctatcgccagttaaaaataaacaacctaccaagtattattctttaaaactaagcatggatgttgatggctaacttctgcggcatataagctacagatctcaagttacttctctaactgtaagcatgtaaatgactttaactcctttctataagttatgattttaaattttcagataagaattgcattttaatatggatatgtgtgcccttaaaagctacagataccaaattttcctcgtccaggtctactcggacgaattttcccccttaatctggccttaaactgagactcggcccttgagagccagggcctggcccagcagtagttgctcatagacctgggaagcaggggcctgctggaaggaatcactagattgctgcaaaaactcacataatccacagtttcctctttttctttttaaaataagttatcaaaatgttttaaaaacactttatgagaccatagtactcagtgccttttgtgagacagtgggtcatttagccttcagcttccctgtttttgatgtagagaaagcttctatttcactggcctcatcccacaagattgtgcgacctttccccgtcatagcctgtcgtgacaatcacgctattgaaagtggctttctagttaaaatgcaattggaaacttgacagtctctaaatgaattaaaagtttcctttggggctatttagcttaacagcagtctacaaataattaaagtgtgagcttaagaaaagtatctttgcggggagaaaaatgtcagatatttttaatgcccagctataaataattttggtgtcttgatatttatacatgcaaaatagaaaaaaaatgttcaacatttattgattgatagactgttaaaatttaatgtttggaataacatttggaagtagtagactttgcattaaaaaatggcttttctttaggaaagtataatcaattattttaatgaccatagcattcatggactcaaatgctgctgccacacacaactcaagtgctggaatatttttctacagtctctctgttctacggattatcttgtaaaccagtgttcaactagttttataactgaaaagctgcacatttttcacagtacaagccgtagtttttacctgtagtttggacttctctgttagaatgtaactgcattaccagcccttttaaaggcatctatctatcaaaggaaaatttgggtgttagattttcttgggaccgtttctgtaacctttgcccttcacaatatagaaaatattggttttgccattacattttaatgccaggtttaaaacctgttgaaagctgcagctttatacagctttcttctccctgtgaaatcactttgtttatgtgatggcatttaaaaaatagcatgttctttttaaactgaattttatatctaatcaatgtcttcagtcttgaagaagaatttgcattgttgtgtttgtatatagagtattgcagtgcatgaattagctttatgcattttattaaatgctgtttcaatgtggcattattgttgtggcttaatactactacctaaatgaggtttatactattaaaagtgaattaaagactaa

SEQ ID NO: 706 - DNA, 3271 bp, Homo sapiens
agggacgccctattcccctccccgcggctgcctgtcagagcgcttctggagatattacaggggacccagcccgcagcgacaggcacaaagtcacggggtaatgaacttcggggacccttcgccgctgcgtgcgcggctctccccggaaacccggacctggccgcctcttccctcggaagatttcccagcaatctagttttcccactctgcgcttgggttccggcagcgcggagcccgtctgcctctgagactgcggtagtgttttccttctttccttgggagaccagcggtcggcagagattgcccacactctgcatgcctatgtagagggagagatcgaagactgagtgacaggaatggggaaaaagagggatttcgctccgtaggaaggccattttcgtgtctccatctctgtctttcaacatccctctcttgctgttcttccttcttcctcagtcttcctgtccatctctccatctgtctgtccatgtgtgtgtccatatcaagcagcattcccagcagctgcggttttgcaagagccgggaagaaacttaaggatgcttaaatttccactgttggacgaattctgagcgcccagggagcagcgcagcgcgcgactgacacccacctgtcccgcccaggagccttgcaggctggagggcagctggagagcggcggcgcccggcggcgaggcgggcgctgccggccgggactcgggcagcgcccaccaaccgctccgccccgggacagccagcatgagcaagccagccggatcaacaagccgcattttagatatcccctgcaaagtgtgtggcgaccgcagctcggggaagcactacggggtctacgcctgcgacggctgctcaggttttttcaaacggagcatccgaaggaataggacctatgtctgcaaatctggaaaccagggaggctgtccggtggacaagacgcacagaaaccagtgcagggcgtgtcggctgaagaagtgtttggaagtcaacatgaacaaagacgccgtgcagcacgagcgggggcctcggacgtccaccatccgcaagcaagtggccctctacttccgtggacacaaggaggagaacggggccgccgcgcactttccctcggcggcgctccctgcgccggccttcttcaccgcggtcacgcagctggagccgcacggcctggagctggccgcggtgtccaccactccagagcggcagaccctcgtgagcctggctcagcccacgcccaagtacccccatgaagtgaatgggaccccaatgtatctctatgaagtggccacggagtcggtgtgtgaatcagctgccagacttctcttcatgagcatcaagtgggctaagagtgtgccagccttctccacgctgtctttgcaagaccagctgatgcttttggaagatgcttggagagaactgtttgttctaggaatagcacaatgggccattccggttgatgctaacactctactggctgtatctggcatgaacggtgacaacacagattcccagaagctgaacaagatcatatctgaaatacaggctttacaagaggtggtggctcgatttagacaactccggttagatgctactgaatttgcctgtctaaaatgcatcgtcactttcaaagccgttcctacacatagtggttctgaactgagaagtttccggaatgctgccgccattgcagcccttcaagatgaggctcagctaacgctcaacagctacatccataccagatatcccactcaaccctgtcgctttggaaaactcctgttgcttttgccagctttacgttctattagcccatcaactatagaagaagtgtttttcaaaaaaaccatcggcaatgtgccaattacaagactgctttcagatatgtacaaatccagtgatatctaagctcacaagatacccacttttcaggatgggacagtatcagatgaacttcaacccatggagaacaagcctcaactaacaaacccttcaggaagcatataccggggaatgtgtagccttcaggaaaaaaatgccaattgacacaaagcattccagtagctatgacctgccgccctgaccaggatagggcgggtgggaaggagaggggtgcaacaggaccgcctgcactgaaaactcactgctgccatgccctgggagggggcaaactgggggttgccacaggccgtgccattctgcctcttacctggaagatcaggctgaacgatcaaaagctgaaacataagtagtgctttctcttcctttttagcatacaaagtttggtaaccaaatatagctctgtgtataacatcgtactgcggccttcaaaactacgttatgttggagcatttattttaaaaataatggtaggttttaaattaaaagtgttatcaaaagtttcccctctattgtaatacattattaagtggccttcagaactgagttaataagtgaaaagtagcttatgccatgtgatttgctttttctctatcttcttttttcttttctttctctttcttttgttctttcttcttcttttttaataccataggccaggcaaccttgtcaaaggaattgatggacaaaatgagattctcaccaggacttcaggttggataacatgtcaaaaagagaagagctttactaaaagaacataagtcaagggaggatgaataaaaacagcaaaaccaaataaagtggagatgagtgattgagtgaggtagattgctgtcccgttaacatagtgctgaaaccaaaggcagtgggggtccaaactcgtggtgcagcaagtcacaccagacaggaaacgaatatggacgtaattgcagaaggaacttcaaggagatgaatgaatgctaaaagggttcttgactgatccattgctaacagcctgagactcttcaatgcctttccgaaaactggtttctagtaaagccttgaatgaacacacacacacacacacacacacacacacacacacacacacacacacaccgtcctacactttaagctgctcctttggtatgactctatacttatggaaatgtagaaacaaacatttttaaatagctgctgtacttttcacattttgatttattaggtactagcactgaggaaaaaaaattcagcacttggactatcataggatgagtaaaacttttcttgtacaaagtgaattaactgatttgtgaagttaaaaggttgtactcattgtatttacaaagaataaaaatatattgaatttaaatgaaaaaaaaaaaaaa

SEQ ID NO: 707 - DNA, 2102 bp, Homo sapiens
agaaatctcctcaagccagagcctgtgctgtgaggggcttcgggaccttggggcagctcctgagttcagacagagttcaggaagggagacaggggcacagagagacagaggttcatggactgaggcaaaggctgggccaggctcagcaacccaggcctcccgcaggcaggcagaggctgccctgtaacccatggagaccagaccaacagctctgatgagctccacagtggctgcagctgcgcctgcagctggggctgcctccaggaaggagtctccaggcagatggggcctgggggaggatcccacaggcgtgagcccctcgctccagtgccgcgtgtgcggagacagcagcagcgggaagcactatggcatctatgcctgcaacggctgcagcggcttcttcaagaggagcgtacggcggaggctcatctacaggtgccaggtgggggcagggatgtgccccgtggacaaggcccaccgcaaccagtgccaggcctgccggctgaagaagtgcctgcaggcggggatgaaccaggacgccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatgctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggaccccacggagtttgcctgcatgaaggccttggtcctcttcaagccagagacgcggggcctgaaggatcctgagcacgtagaggccttgcaggaccagtcccaagtgatgctgagccagcacagcaaggcccaccaccccagccagcccgtgaggtgacctgagcatgcgcccacccactcatctgtccctgacctctaacctttctctgcctctcccacactctcccagagctcactgattagacagcacaagggtctcagttcaacagcatacagccaacatctatggtgtcccaggcacagtgccaggccccgggagtggggaccaagatgtacataagacaaagctactgccttctagagacaaccggcagtgacctcactgaagacaaaaactgccctagccaggtactgagggttgcatgaatctgcaggagacagagatccccttgcatgggaaacataaagcagaattgggagggactttgtggagacagggctggacttgaaaggaagaagaagtctaaaagaaaacatcatttgcaaagggagagaggggcaagcatgatatgttgttagaacaggagcccactttgaaggtataacaggttcctgccagtgagaaatggggagaataagccagaaaagtaccctaggaccagcccgttcaggactttgaatgccagccaaaggccacgtctgacttgggaggcagagggcagctactgcaggtttccgagcagagggtcatacacagggctggacctcacgcagactggcatggccatgggtccagaggatactactgggaaggggatggcagctactgccaccttccagatggttccatggagttctgatctttgggcatggccaggggaagcagaagggagactctaggagttgaaatgggtcagacccggtgtttgggtgaaggtaaggaatgagggaagaggagctctttg

SEQ ID NO: 708 - DNA, 3210 bp, Homo sapiens
cctctttctcccccctctctccctcctctcctctctctctcctctcttctctgaacctctcttctctttctcttttcttacatattctactagttgttttccccttcttcttctcctttctctcctttttctccctcctccttgtctcttttactccattcctgcagaagagagagggctaaacttaaaaaaaaaaaaaaggaggaggaggaggaggaggcacccccttcgtattcttcttatcgttattttatacatatatgattttttttggagggagggtgttggttgccggctgaagagcacttatttaaaatactaaaaaaagaacatttttgggcgatctccagggtttttttaactagctctgtgtgttatagcagaagaagcagaagaaggagcaagaaagaggaaaagaagaggattatttattcgacctactttggatgtctctctcgcttttcctttttcctttttttggcaattattttcttctgatttttattttttctatttcgctgtgatttcgtcgccggcgtgaattatcccgtatttttctcccccttccgtcacctcccgaaagaagaaggcagcgagagcccggcgccaccggcacaacaaaaagagcaaagtgtgtgatcttcctcgccggctgcctcccgctctccagcgctgccttcctgaatggctggctgcgtccggccctggacctggccccccgacacccgcgcgccctgatcgccggcggcagcctcgcccagcgccctgctcggctcaccgcgctccccgcactcccgagcccggcgagggctcccgccgggacagcggcggcgccgcgggcggccccggcctccgctcgcgctccggctgcggccccgactcctgctcggactccggcccgggtcccggctcctccagcggcgctcgccgcagcagctccggcggcagctccagcggcgcctgcagccgcgacctcctcctcctccgccgccgccgccgcctccgccctcgccggcttcctctatgtcggctcagcccgcgcgctgcgcgtagcccgagcggccggcgggcgggcgcccggcgcgggtgagcgactgtgtgtgcgagtgtgtgtgtgcgcgggggtgcgggcgaggcggagggcgagtgtgtgcgcgcgccgtggcccatgcccgccgcccccggcgctgcgccccgcgccgctcccggctgccgcctgtgccatttctgattttgcaacttggggaagaagaaaaaagcgagagaagggagcttgctcgccggggggtggggaggggggaaggagagcgcggcccccccaggaacggagcgcggggggagcgggcgaggggagcaggggtgttggggggggagcctgagagcctgggggggctgcaaaaagagagaaagaaaacagcaggaaccacaacaaaacgccagcagggcgggcgggcgcgcagcagcagcggggcggccgaggcagtagcggcggcagcggcggcggcggcggaggcagcggccggtgtccggctcgggctcggctcctgcgaccccggggcgcccggcgggccccccgccccctccccctccccccttccccttccccttcccctcccagcgcgcccgcgcgccccgcggccctcggcgagcagctcggctccccccagcgctccccgggcccaaagatatggcaatggtagttagcagctggcgagatccgcaggacgacgtggccgggggcaaccccggcggccccaaccccgcagcgcaggcggcccgcggcggcggcggcggcgccggcgagcagcagcagcaggcgggctcgggcgcgccgcacacgccgcagaccccgggccagcccggagcgcccgccacccccggcacggcgggggacaagggccagggcccgcccggttcgggccagagccagcagcacatcgagtgcgtggtgtgcggggacaagtcgagcggcaagcactacggccaattcacctgcgagggctgcaaaagtttcttcaagaggagcgtccgcaggaacttaacttacacatgccgtgccaacaggaactgtcccatcgaccagcaccaccgcaaccagtgccaatactgccgcctcaagaagtgcctcaaagtgggcatgaggcgggaagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgaggaaaaacaaaaaaaaaaaaaaa

SEQ ID NO: 709 - DNA, 5110 bp, Homo sapiens
gccgtactgccttttttcccctctttcattctttctctccgtctttttctcccccctctgcgcacgaaggatgtgcttctaggtggtgatctgccctcctctctctcttttatcatttctcccccgccgccggcgagttgactctttccctatgtgtgtgaggcggcggcggcagcagcagcagcagcggctccggcggcggcagcagcggcagcagcgacttcagcggcggcggcggcgctagacgcagcggctccgggcccgacccggcggcttcggcggcggctccggcggcagcggcggcccgggcggcccgcagggaacggcgagcggcctccacccagcgactgcgggcggcggcggccggagagagcgaggcgcgcgccggacgcccggggcaggcggcggcggcggcggcccagcgccaggacgacgccgcgcagcgcccgacgcggaccactttcatgctgattcccccggacccgggcagcgctccggccactccgcgggccgccggcctccgccccggcctgcctggctccctgggcgcgcccgcacccggcgcctccgatctcctagtcctcctgatttcgatggctttcctgaatggctgactgtgggctgccctggacttggcccccggacagtcgcctctcctcctcctctacctcctccttcaccaccacctcctcttcctcctcctcctcctcctcctcctccgccaactcctcggctgcacaccagctctaagagcgagagtgaacgagagagggagggagagagtgagagcgagcgagatctttggagagatttttttttttgcctcctacttctgtcttgaagccagacaatcgacttcagctctccctcccctccctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaaagcaaaaacaaaaaaggaaaaactaaccaacctcaaccaaccagcccccgagccacccggggcgccctcccgcgccctcttgcaccctcgcacacacaaaaggcggcgcgccggagcccgagacccggggagccgccgccgccccgccgccgcccgcagccaggggagcaggaagtccggacgcagcccccatagatatggcaatggtagtcagcacgtggcgcgacccccaggacgaggtgcccggctcacagggcagccaggcctcgcaggcgccgcccgtgcccggcccgccgcccggcgccccgcacacgccacagacgcccggccaagggggcccagccagcacgccagcccagacggcggccggtggccagggcggccctggcggcccgggtagcgacaagcagcagcagcagcaacacatcgagtgcgtggtgtgcggagacaagtcgagcggcaagcactacggccagttcacgtgcgagggctgcaagagcttcttcaagcgcagcgtgcggaggaacctgagctacacgtgccgcgccaaccggaactgtcccatcgaccagcaccatcgcaaccagtgccagtactgccgcctcaaaaagtgcctcaaagtgggcatgagacgggaagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctgaaacctggctgtccccactcactgtctttacatctagaagagcccctgtgagctctcgcttagctggccgggcggggggtggtgggggggggcatttgtttactcccctcagtcagtttgttcaaaggtggactactgtatttgcctgtttaatttgggtgtgtgtgtgttggggggggagctgaagttaatggtttatctatggtttaggaagtgccatactgatatagtaaaccacccccattcacctaatcctccttttaattaaaaatggattttccaggaaaaaaaaaaaggcccttatatttgtcacacttaagtgcctgcttagggaaggtattgtgaaaaagtattagaaatcttgagatcagtatctattttatgatcagaaaaaaatactcttttgtacatttctgacagttactcagaagatcgttcaagcaagctaatcacagcattgtaactagaggacagttgtttgcagtgagtttttccttaagtaggtacgattttttaaaatattctgtgattctactctagcgtggttgttgagagagtttcaaattcagtgatacaggttctaagactgaaaggtctacttttaatgtatatatgataacttgcagttggtttccctctcccctccccccctttaccttcagtctgtgagagcatgaccacagggtcaagggaatcttttccattggagttatgtacataaaaacacatcgacattttgacatttcagattgtgtggctacaatctgtactgctcttgggatcctttgtccttagaagccaaattaaggaagagaaagcaggacagagaaaaagaaagaaggaaggagggaaactttacagggtgtgctgatttggaagtagtaactatttcttttggagtctttttttcatttttcctctttctcttttcctggtttggaggaagctcggtgctgggagcttgcaattttgttcttattcaaggtttccaacccacccccccaccgccagtacttcatcatgttgtggtttaattctaattggtgggggggggggaggactagtgagggaggtgaaagaacagggataattttgtaaagtgtattaaacgttaatattcagatccagtcaatacatgcagaccagtaaaatctgatttgtgcagagttctccatctgactctcacttatttctgtagatatatacatatataaatacaagtatgttcttacggcacagtattgctgacctttagttcgaggttttgtcggttgttgttgattttcttcctcttgcaagtgctatccatgtgagtgtgtgaagtttctctaataagtaaaacacaggcccttttccttgtttgttttgtgttagtttattgtaaacagccatttgttgtaaattattattggcattaaattataatttatgattttcaaagcaaaagacaa

SEQ ID NO: 710 - DNA, 1804 bp, Homo sapiens
gtgcagcccgtgccccccgcgcgccggggccgaatgcgcgccgcgtagggtcccccgggccgagaggggtgcccggagggaagagcgcggtgggggcgccccggccccgctgccctggggctatggccatggtgaccggcggctggggcggccccggcggcgacacgaacggcgtggacaaggcgggcggctacccgcgcgcggccgaggacgactcggcctcgccccccggtgccgccagcgacgccgagccgggcgacgaggagcggccggggctgcaggtggactgcgtggtgtgcggggacaagtcgagcggcaagcattacggtgtcttcacctgcgagggctgcaagagctttttcaagcgaagcatccgccgcaacctcagctacacctgccggtccaaccgtgactgccagatcgaccagcaccaccggaaccagtgccagtactgccgtctcaagaagtgcttccgggtgggcatgaggaaggaggcggtgcagcgcggccgcatcccgcactcgctgcctggtgccgtggccgcctcctcgggcagccccccgggctcggcgctggcggcagtggcgagcggcggagacctcttcccggggcagccggtgtccgaactgatcgcgcagctgctgcgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgagctgccggtggccgaccaggtggcgctgctgcgcctgagctggagcgagctcttcgtgctgaacgcggcgcaggcggcgctgcccctgcacacggcgccgctactggccgccgccggcctccacgccgcgcctatggccgccgagcgcgccgtggctttcatggaccaggtgcgcgccttccaggagcaggtggacaagctgggccgcctgcaggtcgactcggccgagtatggctgcctcaaggccatcgcgctcttcacgcccgacgcctgtggcctctcagacccggcccacgttgagagcctgcaggagaaggcgcaggtggccctcaccgagtatgtgcgggcgcagtacccgtcccagccccagcgcttcgggcgcctgctgctgcggctccccgccctgcgcgcggtccctgcctccctcatctcccagctgttcttcatgcgcctggtggggaagacgcccattgagacactgatcagagacatgctgctgtcggggagtaccttcaactggccctacggctcgggccagtgaccatgacggggccacgtgtgctgtggccaggcctgcagacagacctcaagggacagggaatgctgaggcctcgaggggcctcccggggcccaggactctggcttctctcctcagacttctattttttaaagactgtgaaatgtttgtcttttctgttttttaaatgatcatgaaaccaaaaagagactgatcatccaggcctcagcctcatcctccccaggacccctgtccaggatggagggtccaatcctaggacagccttgttcctcagcacccctagcatgaacttgtgggatggtggggttggcttccctggcatgatggacaaaggcctggcgtcggccagaggggctgctccagtgggcaggggtagctagcgtgtgccaggcagatcctctggacacgtaacctatgtcagacactacatgatgactcaaggccaataataaagacatttcctacctgca

SEQ ID NO: 711 - DNA, 6784 bp, Homo sapiens
ggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 712 - DNA, 5915 bp, Homo sapiens
aaaagggccagccctccagctggcccactccccctccgggctttcgcccgccctctctccctcccttttttgcccgccctggccctgcccctgcccctgccccctcctctcagcccctccgcgcccggggtgtcattgggcccgggagacgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagcgatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgagcgctcacaccttcccccgttatggtccttgaaaacattgaacctgaaattgtatatgcaggctatgacagctcaaaaccagatacagccgaaaatctgctctccacgctcaaccgcttagcaggcaaacagatgatccaagtcgtgaagtgggcaaaggtacttccaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaaatatatacagattcctgttgtgtaataacagaactcgtggcgtggggcagcagctgcctctgagccctcgctcgtccacggtcttctgcatcactggtatacacactcgttagcgtccatttcttatttaattagaatggataagatgatgttaaatgccttggtttgatttctagtatctattgtgttggctttacaaataattttttgcagtcttttgctgtgctgtacattactgtatgtataaattatgaaggacctgaaataaggtataaggatcttttgtaaatgagacacatacaaaaaaaatctttaatggttaataggatgaatgggaaagtatttttgaaagaattctattttgctggagactatttaagtactatctttgtctaaacaaggtaatttttttttgtaaagtgcaatgtcctgcatgcataatgaaccgtttacagtgtatttaagaaagggaaagctgtgccttttttagcttcatatctaatttaccattattttacagtctctgttgtaaataaccacactgaaacctcttcggttgtcttgaaacctttctactttttctgtactttttgttttgttcttggtctcccgcttggggcatttgtgggactccagcacgttttctggcttctgcttcatcctgctccatcggggaatgacacactgcggtgtctgcagctcctggaaggtgtcatttgacaacacatgtgggagaggaggtccttggagtgctgcagctttgggaaagctgcctcgtttcccttttcctctagaagcagaaccagctctacgagagtgagactgggaacttgatggctcagagagcatcttttcctcccattttagaaaatcagattttctcctgtgggaaaaaaaaattccatgcactctctctctgttaaagatcagctattcccttctgatcttggaaagaggttctgcactcctggaaccggtcacaggaacgcacagatcatggcaggatgcgctgggacggcccatcttggcaaggttcagtctgaatggcatggagaccgggagatagaggggttttagatttttaaaaggtaggttttaaaaataagttttatacataaacagttttggagaaaaattacagatcatataagcaagacagtggcactaaaatgtttaattcattaatctgtttgtttggcactgatgcaatgtatggcttttctcttgccccaaatcacaaacatatgtatctttggggaaactaacaatatgattgcactaaataaactactttgaatagaggccaaattaatcttttaaaaatgatgataatcatcaggtttactcagtgaaatcatattaattattttccaaaatctaaaagctgtagctggagaagcccatggccacgaggaagcagcaattaattagatcaacacttttctccagggttcaccatgcaggcaacattaccttgtctttcaaaagacacctgccttatgcaaggggaaacctgtgaaagctgcactcagagggaggagtttttcttacataatttgcaatttcaggaatttaatttataggcagatctttaaatacagtcaacttacggtgcacagtaatatgaaagccacactttgaaggtaataaatacacagcatgcagactgggagttgctagcaaacaaatggcttacttacaaaagcagcttttagttcagacttagtttttataaaatgggaattctgacttacttaaccaggtttgggatggagatggtctgcatcagctttttgtattaacaaagttactggctctttgtgtgtctccaggtaactttgcttgattaaacagcaaagccatattctaaattcactgttgaatgcctgtcccagtccaaattgtctgtctgctcttatttttgtaccatattgctcttaaaaatcttggtttggtacagttcataattcaccaaaagttcatataatttaaagaaacactaaattagtttaaaatgaagcaatttatatctttatgcaaaaacatatgtctgtctttgcaaaggactgtaagcagattacaataaatcctttactttaatcaaaaaaaaaaaaaaaaaa

SEQ ID NO: 713 - DNA, 2699 bp, Homo sapiens
ggagcgcttaagaggagggtcgggctcggccggggagtcccagtggcggaggctacgaaacttgggggagtgcacagaagaacttcgggagcgcacgcgggaccagggaccaggctgagactcggggcgccagtccgggcaggggcagcgggagccggccgggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaaaaaaaaaaaaaaaaaaaaaaaaaaaaaaa

SEQ ID NO: 714 - DNA, 3546 bp, Homo sapiens
gctgacgcgcgctgacgcgcggagactttaggtgcatgttggcagcggcagcgcaagccacataaacaaaggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaaccatgtaaatgaacagaaaaaaaaaaaaaaaaa

SEQ ID NO: 715 - DNA, 5635 bp, Homo sapiens
ataaatgacgtgccgagagagcgagcgaacgcgcagccgggagagcggagtctcctgcctcccgccccccacccctccagctcctgctcctcctccgctccccatacacagacgcgctcacacccgctccctcactcgcacacacagacacaagcgcgcacacaggctccgcacacacacttcgctctcccgcgcgctcacacccctcttgccctgagcccttgccggtgcagcgcggcgccgcagctggacgcccctcccgggctcactttgcaacgctgacggtgccggcagtggccgtggaggtgggaacagcggcggcatcctcccccctggtcacagcccaagccaggacgcccgcggaacctctcggctgtgctctcccatgagtcgggatcgcagcatcccccaccagccgctcaccgcctccgggagccgctgggcttgtacaccgcagcccttccgggacagcagctgtgactcccccccagtgcagatttcgggacagctctctagaaactcgctctaaagacggaaccgccacagcactcaaagcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctgcagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagagccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgcccttgtccgagctttaacagactcaacacccagagatcttgattattccagatactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtcaaacactgctgaagataagtttgtgttctgcaatggacttgtcctgcatcgacttcagtgccttcgtggatttggggagtggctcgactctattaaagacttttccttaaatttgcagagcctgaaccttgatatccaagccttagcctgcctgtcagcactgagcatgatcacagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggacaccctacctttctaatcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggcaaaacaataatggctgtttgcttccataaacaagtgcaattttttaaagtgctgtcttactaagtcttgtttattaactctcctttattctatatggaaataaaaaggaggcagtcatgttagcaaatgacacgttaatatccctagcagaggctgtgttcaccttccctgtcgatcccttctgaggtatggcccatccaagacttttaggccattcttgatggaaccagatccctgccctgactgtccagctatcctgaaagtggatcagattataaactggattacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatctttttaaaaaatagtatgaatgtgaatactagaaaagatttaaaaaatagtatgagtgtgagtactaggaaggattagtgggctgcgtttcaacattccgtgttcgtactcccttttgtatgtttctactgttaatgccatattactatgagataatttgttgcatagtgtccttatttgtataaacatttgtatgcacgttatattgtaatagctttgcctgtatttattgcaagaccaccagctcctggaagctgagttacagagtaattaaatggggtgttcacagtgacttggatacaccaattagaaattaaataagcaaatatatatatatatataaatatagcaggttacatatatatatttataatgtgtctttttattaaccatttgtacaataaatgtcacttcccatgccgttattttatggttcatttgcagtgacttttaaggcagtactgtttagcactttgatattaaaattttgcttatgttttgctaaattcgaataatgtttgaagatttttaggtctaaaagtctttatattatatactctgtatcaagtcaaaatatctttggccattttgctaagaaacaaactttgaatgtcaaactgatgtcacagtagtttttgttagctttaaatcatttttgctttagtctttttaaaggaaaataacaaaactatgctgtttatattgtcattaaattatacaatcaaacaaatgccaaatgaattgcctaattgctgcaaagtataacccagataggaaatcatatgtttttttccaagagtcattctaatatttgattatgttatgtgtgcttttatgaaagattgttatttttatatatcaagatgatagaacctggaatgttaggattttgaaatgttagacttggaaggggcctggtctgtcaactagtccaaccccttaaaattcatagaggagcaaactggggcccattgaagggtgaagagttactcaaggtcaaacagctggtaacagaatcaagactaagacctaatttacctttccatactctttttttttctcaacttcatctatataaaatcaggcttttaaacataaccactaatatttacctgaagataaccatgagtaaagtatacttttgcattaattttttgagcttatatgcaaacataataaatattattaaatatcaggaaagctaacatttcatacaagatagcttcagaccaaattcaaattgaatttgaataaattagaaatactgtgcatacataaccttcttgtgcaccatgagtatttggaaagttaatccttgtttttgtcgtgtctataaaggaagaacaaaacaaaataaaaacagagccctagagaaatgctgttactttttatttttacacccatcagatttaaggaaaagactttttagccattataatctagtggttggaaggaatgaagaagcttttttagtaataggtccagatatgagtgctaaaaataaagatgatagcatgttcttctgtcttccatagttattacaactatgagagcctcccaagtcatcttatcaactcaactcccttttttttgtcttaatgttgcacataagtttatacagagtggatgaccacactagcacagaagagaacaacatgtattaaagcaggtgattcctccccttggcgggagagctctctcagtgtgaacatgccttctgtgggcggaaatcaggaagccaccagctgttaatggagagtgccttgcttttatttcagacagcagagttttccaaagtttctctgctcctctaacagcattgctctttagtgtgtgttaacctgtggtttgaaagaaatgctcttgtacattaacaatgtaaatttaaatgattaaattacattttatcaatggca

SEQ ID NO: 716 - DNA, 3095 bp, Homo sapiens
ggaggacggacggacagggccagcctgctgtccggctgccgcccgccgtggtgtgagggggtttctgcgcacccacagtcgccaccgtcccacctgggctgccggagcctccccctggacccctggtgcccactgccaccctcatccggtgtgagagcgctgcttccgcttcgcggacgccgcgggcatggactattcgtacgacgaggacctggacgagctgtgccccgtgtgcggggacaaggtgtccggctaccactacggactgctcacgtgtgagagctgcaagggcttcttcaagcgcacggtgcagaacaacaagcactacacgtgcaccgagagccagagctgcaagatcgacaagacgcagcgcaagcgctgtcccttctgccgcttccagaaatgcctgacggtggggatgcgcctggaagccgtgcgcgctgaccgtatgaggggtggccggaacaagtttgggccgatgtacaagcgggaccgggccctgaaacagcagaagaaggcacagattcgggccaatggcttcaagctggagacagggcccccgatgggggtgcccccgccgccccctcccgcaccggactacgtgctgcctcccagcctgcatgggcctgagcccaagggcctggccgccggtccacctgctgggccactgggcgactttggggccccagcactgcccatggccgtgcccggtgcccacgggccactggctggctacctctaccctgcctttcctggccgtgccatcaagtctgagtacccggagccttatgccagccccccacagcctgggctgccgtacggctacccagagcccttctctggagggcccaacgtgcctgagctcatcctgcagctgctgcagctggagccggatgaggaccaggtgcgggcccgcatcttgggctgcctgcaggagcccaccaaaagccgccccgaccagccggcggccttcggcctcctgtgcagaatggccgaccagaccttcatctccatcgtggactgggcacgcaggtgcatggtcttcaaggagctggaggtggccgaccagatgacgctgctgcagaactgctggagcgagctgctggtgttcgaccacatctaccgccaggtccagcacggcaaggagggcagcatcctgctggtcaccgggcaggaggtggagctgaccacagtggccacccaggcgggctcgctgctgcacagcctggtgttgcgggcgcaggagctggtgctgcagctgcttgcgctgcagctggaccggcaggagtttgtctgcctcaagttcatcatcctcttcagcctggatttgaagttcctgaataaccacatcctggtgaaagacgctcaggagaaggccaacgccgccctgcttgactacaccctgtgccactacccgcactgcggggacaaattccagcagctgctgctgtgcctggtggaggtgcgggccctgagcatgcaggccaaggagtacctgtaccacaagcacctgggcaacgagatgccccgcaacaacctgctcatcgaaatgctgcaagccaagcagacttgagcctgggccgggggcggggccgggactgggggcgggactgggggcggggcctgggcggggccgcagccacaccgctggctccgcatggttcattttctgatgcccaccgaggagccccagccccgtcccagaggccgctgcccctgagttctgacactgtgtgtttgggaaggtgggtgaggctgggcagggcctggcggaggtggagtggccactggcacttgcctgctgcttggagtgccccaaggaggtggctgttaaccacccgccccgccccctccctgctcccagctctctctcctggagtctgaagcctgcaggtccggggaggaggttcgggattccctggtgggcctcgacgtcccttggatcagaggtcatcccttcctcctctcctggaaacagacagggagaagttgagcaggtatcaactaggggaggagagagggtctccagtgttccccccatagagaccaggagggagagcctctgttttgtaaactaaggataaccgagtttgctaaattgagaggggctattgggccctagaggacactaggagactggttaggacaaaaagaccttctccctagcccttctaccccacctgacctctgcaagagggggcattgatacatcatcgggaaaaaactttgctccaggcatcactgattccctctcccacccaaggagaacgtttggtacaatcgacatcctagccccacccagaggtggccctcccaggctggtatttatctgcaaggttgtagtcaagaggtttttctccccgctttttgtttttaagcttctagacactccttgaaatgtgtgtgtgatggagggaaggggacagatttgaggactgaagctggggcttggggattgccactaagtacagctgacggtttctccccggacactcgcctactaagtacccttggggtggtgctgggtcattacttctgagccccagccccaatccagagaagcgctgttgcccgccctccacccactaggtgaacagcaggatgccctgttgggggcttcaggtctctgtgggtgggaatgcaagtgaacttgggagggggcacgggcctgtagatcagggatagcgctgttgatcccctctctgtggctccaacccgttgggtcccttgctgcaaacccatgaagctggccctcagctccctgaccccctgtcctaggtcatgaaggacactctgcagggtgaagcaccagggagaggcctcggctgtctcctgtccccggcggggtgcctgctgtccgtcccgctttcatgttactgttgcagcttgtgctgagcctgcccagttggaggagactgggcacccctgcctcctgcctcccgcctcccgccaccctgtctcagtacctcccctccccgccccctgaaacatgtgcccctgccaaggccggagacccacagccctgaaacgagaagtgcccttaaggatcaccccagcccccacagccctggaataaatttcgcaattagtttcca

SEQ ID NO: 717 - DNA, 4916 bp, Homo sapiens
aaaaagtacagagtccagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattgtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagtaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggccccagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgtgaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaacattaaacacattttgctaggatgtcaaatagtcacagttctaagtagttggaaacaaaattgacgcatgttaatctatgcaaagagaaaggaaaggatgaggtgatgtattgactcaaggttcattcttgctgcaattgaacatcctcaagagttgggatggaaatggtgatttttacatgtgtcctggaaagatattaaagtaattcaaatcttccccaaaggggaaaggaagagagtgatactgacctttttaagtcatagaccaaagtctgctgtagaacaaatatgggaggacaaagaatcgcaaattcttcaaatgactattatcagtattattaacatgcgatgccacaggtatgaaagtcttgccttatttcacaattttaaaaggtagctgtgcagatgtggatcaacatttgtttaaaataaagtattaatactttaaagtcaaataagatatagtgtttacattctttaggtcctgaggggcagggggatctgtgatataacaaaatagcaaaagcggtaatttccttaatgttatttttctgattggtaattatttttaacagtacttaattattctatgtcgtgagacactaaaatcaaaaacgggaatctcatttagactttaatttttttgagattatcggcggcacaatcactttgtagaaactgtaaaaaataaaagtatctcctagtcccttaattttttcataaatatttctggcttttgagtagtgtatttatattgtatatcatactttcaactgtagacaattatgatgctaatttattgtttcttggtttcacctttgtataagatatagccaagactgaagaaaccaaatatatgtgtttactgtagcatgtcttcaaattagtggaacttagttcagggacatagaagagtcttaatgaattaaaatcattcacttgattaaatgtctgtaaatcttcatcattcctactgtagtttatttaatatctattgtaaattatgtgacttgtagcttcctctggttttcaagtaaactcaacaaggtggagtcttacctggttttcctttccaagcattgtaaattgtataccaaagatattagttattacttctgtgtgtacaaagaggattattttattatgtttattaatcacctctaatactcatccacatgaagggtacacattaggtaagctgggcgttgactcatgcgcagtctcagtcacccgtgttatcttcgtggctcaaaggacaatgcaaaatcgccgatcagagctcatacccaaagcattacagagaacagcagcatcattgccctccccagctgaaaaacaagttggctagaagatacatggagaggaatggtgtggtcaacagttaatgaaacggttctatcatgcatgtgtaatgtggatggagacaattataagatttgactataactatttggagggtctttaacattgccaaaaaaacaaatatgttgatttttattttattttattttttattttaagaggcgggatcttgatctcacatgttgcccaggctggccttgaactcctgggctcaagcattcctcctgcctcagcctcccccatagctgggactaggggtgcatgccagcatacctggctacgttgactcttaaaatctatgttctcttattttaaagatacagtgctccccactgaaaattaaacctaaaaaatgtcacatattggtatgttgttaacctggtagattaaatcatgagaatgattagaaagacgggcaacacagcgggttacatccacactgctgatcacaccaacgacaggagctgataagcaagaaagcgtcacagccagcgtctgttcacccaaggttgacaagtgaagtttctctaatgttgattgttagccgatttgtaacctggcatttacttagcaactgccttatcaattacaggatttgccggtaaaagcagactcaaatataaaggtttttggcttaacttggtttattatagttgctctatgtttgtaaacagacaatctctaatgtctgattatttgtatcacagatctgcagctgccttggacttgaatccatgcaatgtttagagtgtgaagtcagttacttgttgatgttttcttactgtatcaatgaaatacatattgtcatgtcagttcttgccaggaacttctcaacaaaatggaattttttttttcagtatttcaataaatattgatatgcccagcctgataatttttaaaaaaaaaaaa

SEQ ID NO: 718 - DNA, 1903 bp, Homo sapiens
gcggcgcggaggggcgcggagcggcgcggagccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaaccgccgcctagcggagggggaggcggcgggggctcggcggggttcctggagcctcccgccgcgctccctccgccgccgcgcaacggtttctgtcaggatgaattggcagagcttgacccaggcactaatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgaaaaaaaaaaaaaaaa

SEQ ID NO: 719 - DNA, 3263 bp, Homo sapiens
ggagcagtggcgctatagccacgaaagtgactggcagtgggctctgcggcgcagcttcatctgtcggcacctgcacagctatcccggggctgccctcgaccagctcctcgcgctctccgccgcctggaccaaccacgtcttcctgggctgcaggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatcagaaaaaaaa

(The sequence listing continues in the following parts.)

We claim:
1. A kit for making induced pluripotent stem (iPS) cells from a fibroblast cell comprising the following components:
   (a) a synthetic mRNA encoding OCT4, wherein each cytosine of the synthetic mRNA encoding OCT4 is replaced with 5-methylcytosine and each uracil is replaced with pseudouracil;
   (b) a synthetic mRNA encoding SOX2, wherein each cytosine of the synthetic mRNA encoding SOX2 is replaced with 5-methylcytosine and each uracil is replaced with pseudouracil;
   (c) a synthetic mRNA encoding KLF4, wherein each cytosine of the synthetic mRNA encoding KLF4 is replaced with 5-methylcytosine and each uracil is replaced with pseudouracil; and
   (d) a synthetic mRNA encoding c-MYC, wherein each cytosine of the synthetic mRNA encoding c-MYC is replaced with 5-methylcytosine and each uracil is replaced with pseudouracil.

2. The kit of claim 1, wherein the synthetic mRNA encoding OCT4 is provided in molar excess of at least three times the concentration of the remaining three synthetic mRNAs.

3. The kit of claim 1, further comprising a fluorescent control protein.

4. The kit of claim 3, wherein the fluorescent control protein is green fluorescent protein (GFP) or nuclear GFP.

5. The kit of claim 1, further comprising a buffer.

6. The kit of claim 5, wherein the buffer is RNAse-free TE buffer at pH 7.0.

7. The kit of claim 1, further comprising a soluble interferon receptor or synthetic mRNA encoding a soluble interferon receptor.

8. The kit of claim 7, wherein the soluble interferon receptor is B18R.

9. The kit of claim 1, wherein the synthetic mRNA encoding OCT4 comprises SEQ ID NO: 788; the synthetic mRNA encoding SOX2 comprises SEQ ID NO: 941 or SEQ ID NO: 1501; the synthetic mRNA encoding KLF4 comprises SEQ ID NO: 501; and the synthetic mRNA encoding c-MYC comprises SEQ ID NO: 636.

10. The kit of claim 1, further comprising a synthetic mRNA molecule encoding LIN28, wherein each cytosine of the synthetic mRNA encoding LIN28 is replaced with 5-methylcytosine and each uracil is replaced with pseudouracil.

11. The kit of claim 10, wherein the synthetic mRNA encoding LIN28 comprises SEQ ID NO: 524.

12. A method for making induced pluripotent stem (iPS) cells from a fibroblast cell comprising:

a) subjecting the fibroblast cell in culture medium to a daily transfection with a transfection mixture comprising
   (i) a synthetic mRNA mixture comprising a synthetic mRNA encoding OCT4; a synthetic mRNA encoding SOX2; a synthetic mRNA encoding KLF4; and a synthetic mRNA encoding c-MYC, wherein the synthetic mRNA encoding OCT4 is provided in molar excess of at least three times the concentration of the remaining three synthetic mRNAs, and wherein each cytosine of each of the synthetic mRNAs is replaced with 5-methylcytosine, and each uracil of each of the synthetic mRNAs is replaced with pseudouracil; and
   (ii) a synthetic mRNA encoding a short half-life nuclear green fluorescent protein (GFP);
b) providing culture conditions comprising 5% O2;
c) removing the transfection mixture four hours after each daily transfection, from the cell in culture medium;
d) culturing the cells in a culture medium not comprising the transfection mixture of step (a) for about three days to allow expansion of the cells;
e) picking cells from the expanded cells of step (d), thereby generating iPS cells to generate iPS cell lines.

13. The method of claim 12, wherein steps (a)-(c) are performed daily for at least three consecutive days.

14. The method of claim 12, wherein the synthetic mRNA encoding OCT4 comprises SEQ ID NO: 788; the synthetic mRNA encoding SOX2 comprises SEQ ID NO: 941 or SEQ ID NO: 1501; the synthetic mRNA encoding KLF4 comprises SEQ ID NO: 501; and the synthetic mRNA encoding c-MYC comprises SEQ ID NO: 636.

15. The method of claim 12, wherein the transfection mixture of step (a) further comprises a synthetic mRNA molecule encoding LIN28, wherein each cytosine of the synthetic mRNA encoding LIN28 is replaced with 5-methylcytosine and each uracil is replaced with pseudouracil.

16. The method of claim 15, wherein the synthetic mRNA encoding LIN28 comprises SEQ ID NO: 524.

* * * * *